(12) United States Patent
Begovich et al.

(10) Patent No.: US 7,993,833 B2
(45) Date of Patent: Aug. 9, 2011

(54) GENETIC POLYMORPHISMS ASSOCIATED WITH PSORIASIS, METHODS OF DETECTION AND USES THEREOF

(75) Inventors: Ann Begovich, El Ceritto, CA (US); Ellen Beasley, Burlingame, CA (US); Michele Cargill, Orinda, CA (US); Steven Schrodi, Livermore, CA (US)

(73) Assignee: Celera Corporation, Alameda, CA (US)

( * ) Notice: Subject to any disclaimer, the term of this patent is extended or adjusted under 35 U.S.C. 154(b) by 835 days.

(21) Appl. No.: 11/899,017

(22) Filed: Aug. 31, 2007

(65) Prior Publication Data

US 2008/0108713 A1    May 8, 2008

Related U.S. Application Data

(60) Provisional application No. 60/844,100, filed on Sep. 11, 2006, provisional application No. 60/928,625, filed on May 9, 2007.

(51) Int. Cl.
*C12Q 1/68* (2006.01)
*C12P 19/34* (2006.01)
*C07H 21/02* (2006.01)
*C07H 21/04* (2006.01)

(52) U.S. Cl. ......... 435/6; 435/91.1; 435/91.2; 536/23.1; 536/24.3

(58) Field of Classification Search ........................ None
See application file for complete search history.

(56) References Cited

U.S. PATENT DOCUMENTS

5,837,832 A * 11/1998 Chee et al. ...................... 506/16
6,316,196 B1 * 11/2001 Morten .............................. 435/6

OTHER PUBLICATIONS

Tsunemi et al; Journal of Dermatological Science, vol. 30, pp. 161-166; 2002.*
rs11209026; NCBI, dbSNP database, Nov. 14, 2003.*
DiCesare et al; Journal of Investigative Dermatology; vol. 129, pp. 1339-1350; 200.*
Cleynen et al; Gastroenterology, vol. 134, p. A461; 2008.*
Kauffman et al; J. Invest. Dermatol. vol. 123, pp. 1037-1044, 2004.*
Mannon et al; N. Engl. J. Med.; vol. 351, pp. 2069-2079, 2004.*
Duerr et al; Science, vol. 314, pp. 1461-1463, 2006.*
Cargill et al; Am J Hum Genet, vol. 80, pp. 273-290; 2007.*
Malhotra et al (Am. J. Of Psychiatry, vol. 161, pp. 780-796, May 2004).*
Hegele (Arterioscler. Thromb. Vasc. Biol.; 2002, vol. 22, pp. 1058-1061).*
International Preliminary Report on Patentability, dated Mar. 26, 2009.
Cargill, M., et al., "A Large-Scale Genetic Association Study Confirms IL12B and Leads to the Identification of IL23R as Psoriasis-Risk Genes," The American Journal of Human Genetics, 2007, vol. 80, pp. 273-290.
Elder, J. T., "Genome-Wide Association Scan Yields New Insights Into the Immunopathogenesis of Psoriasis," Genes and Immunity, 2009, vol. 10, pp. 201-209.
Huffmeier, U., et al., "Genetic Variants of the IL23R Pathway: Association with Psoriatic Arthritis and Psoriasis Vulgaris, but No Specific Risk Factor for Arthritis," Journal of Investigative Dermatology, 2009, vol. 129, pp. 355-358.
Li, Y., et al., "Unraveling the Genetics of Complex Diseases: Susceptibility Genes for Rheumatoid Arthritis and Psoriasis," Seminars in Immunology, 2009, vol. 21, pp. 318-327.
Liu, Y. et al., "A Genome-Wide Association Study of Psoriasis and Psoriatic Arthritis Identifies New Disease Loci," PLoS Genetics, Mar. 2008, vol. 4, No. 3, pp. e1000041 (1-14).
Nair, R. P., "Genome-Wide Scan Reveals Association of Psoriasis with IL23 and NF-kB Pathways," Nature Genetics Advanced Online Publication, Jan. 25, 2009, pp. 1-6.
Tsunemi, Y., et al., "Interlukin-12 p40 Gene (IL12B) 3'-untranslated Region Polymorphism is Associated with Susceptibility to Atopic Dermatitis and Psoriasis Vulgaris," Journal of Dermatological Sciences, 2002, vol. 30, pp. 161-166.
International Search Report and Written Opinion, dated Oct. 7, 2008.

* cited by examiner

*Primary Examiner* — Jehanne Sitton

(57) ABSTRACT

The present invention is based on the discovery of genetic polymorphisms that are associated with psoriasis and related pathologies. In particular, the present invention relates to nucleic acid molecules containing the polymorphisms, including groups of nucleic acid molecules that may be used as a signature marker set, such as a haplotype, a diplotype, variant proteins encoded by such nucleic acid molecules, reagents for detecting the polymorphic nucleic acid molecules and proteins, and methods of using the nucleic acid and proteins as well as methods of using reagents for their detection.

24 Claims, No Drawings

GENETIC POLYMORPHISMS ASSOCIATED WITH PSORIASIS, METHODS OF DETECTION AND USES THEREOF

FIELD OF THE INVENTION

The present invention is in the field of diagnosis and therapy of psoriasis. In particular, the present invention relates to specific single nucleotide polymorphisms (SNPs) in the human genome, and their association with psoriasis and related pathologies. Based on differences in allele frequencies in the psoriasis patient population relative to normal individuals, the naturally-occurring SNPs disclosed herein can be used as targets for the design of diagnostic reagents and the development of therapeutic agents, as well as for disease association and linkage analysis. In particular, the SNPs of the present invention are useful for identifying an individual who is at an increased or decreased risk of developing psoriasis and for early detection of the disease, for providing clinically important information for the prevention and/or treatment of psoriasis, and for screening and selecting therapeutic agents. The SNPs disclosed herein are also useful for human identification applications. Methods, assays, kits, and reagents for detecting the presence of these polymorphisms and their encoded products are provided.

BACKGROUND OF THE INVENTION

Psoriasis is a common, chronic, T-cell-mediated inflammatory disease of the skin affecting ~2-3% of whites of European descent. Although this disease is found in all populations, its prevalence is lower in Asians and African-Americans and also declines at lower latitudes.[1] The most common form, psoriasis vulgaris, is characterized by varying numbers of red, raised, scaly skin patches that can be present on any body surface, but most often appear on the elbows, knees and scalp. The onset of disease usually occurs early in life (15-30 years) and affects males and females equally. Up to 30% of individuals with psoriasis will develop an inflammatory arthritis, which can affect the peripheral joints of the hands and feet, large joints, or the central axial-skeleton.[2,3] Pathologically, psoriasis is characterized by vascular changes, hyperproliferation of keratinocytes, altered epidermal differentiation and inflammation.[4] In particular, the reaction of cells in the epidermis to type 1 effector molecules produced by T-cells results in the characteristic pathology of the plaques.[5]

The genetics of psoriasis are complex and highly heritable as evidenced by an increased rate of concordance in monozygotic twins over dizygotic twins (35%-72% vs. 12-23%) and a substantially increased incidence in family members of affected individuals (first-degree relatives 6%); however, it is clear that environmental effects are also responsible for disease susceptibility.[5] Ten genome-wide linkage scans have resulted in strong evidence for a susceptibility locus in the MHC region on 6p21 (PSORS1 [MIM 177900]), but have not yielded consistent evidence for other regions.[5]

Linkage and association in the MHC (6p21) are thought to be due to HLA-C, in particular psoriasis susceptibility effects are thought to be caused by the *0602 allele[6,7], although other candidate genes in the area may also contribute to disease predisposition. Association studies have identified three genes under linkage peaks, with considerable evidence for linkage disequilibrium with psoriasis, namely SLC9A3R1/NAT9 and RAPTOR (KIAA1303) in 17q25, and SLC12A8 in 3q21.[8,9] Several other genes including VDR, MMP2, IL10, IL1RN, IL12B, and IRF2 (Genetic Association Database, OMIM) have been associated with psoriasis in sample sets of varying sizes and of different ethnicities; however, without more data from additional independent studies, it is difficult to draw statistically sound conclusions about whether these markers are truly associated with disease. Thus, there remains a need for the discovery of reliable markers that can associate themselves with psoriasis, and in turn, would facilitate the diagnosis and treatment of the disease. The discovery of genetic markers which are useful in identifying psoriasis individuals who are at increased risk for developing psoriasis may lead to, for example, better therapeutic strategies, economic models, and health care policy decisions.

SNPs

The genomes of all organisms undergo spontaneous mutation in the course of their continuing evolution, generating variant forms of progenitor genetic sequences (Gusella, *Ann. Rev. Biochem.* 55, 831-854 (1986)). A variant form may confer an evolutionary advantage or disadvantage relative to a progenitor form or may be neutral. In some instances, a variant form confers an evolutionary advantage to the species and is eventually incorporated into the DNA of many or most members of the species and effectively becomes the progenitor form. Additionally, the effects of a variant form may be both beneficial and detrimental, depending on the circumstances. For example, a heterozygous sickle cell mutation confers resistance to malaria, but a homozygous sickle cell mutation is usually lethal. In many cases, both progenitor and variant forms survive and co-exist in a species population. The coexistence of multiple forms of a genetic sequence gives rise to genetic polymorphisms, including SNPs.

Approximately 90% of all polymorphisms in the human genome are SNPs. SNPs are single base positions in DNA at which different alleles, or alternative nucleotides, exist in a population. The SNP position (interchangeably referred to herein as SNP, SNP site, SNP locus, SNP marker, or marker) is usually preceded by and followed by highly conserved sequences of the allele (e.g., sequences that vary in less than 1/100 or 1/1000 members of the populations). An individual may be homozygous or heterozygous for an allele at each SNP position. A SNP can, in some instances, be referred to as a "cSNP" to denote that the nucleotide sequence containing the SNP is an amino acid coding sequence.

A SNP may arise from a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion or deletion variant referred to as an "indel" (Weber et al., "Human diallelic insertion/deletion polymorphisms", *Am J Hum Genet.* 2002 October; 71(4): 854-62).

A synonymous codon change, or silent mutation/SNP (terms such as "SNP", "polymorphism", "mutation", "mutant", "variation", and "variant" are used herein interchangeably), is one that does not result in a change of amino acid due to the degeneracy of the genetic code. A substitution that changes a codon coding for one amino acid to a codon coding for a different amino acid (i.e., a non-synonymous codon change) is referred to as a missense mutation. A nonsense mutation results in a type of non-synonymous codon change in which a stop codon is formed, thereby leading to premature termination of a polypeptide chain and a truncated protein. A read-through mutation is another type of non-synonymous codon change that causes the destruction of a stop codon, thereby resulting in an extended polypeptide product. While SNPs can be bi-, tri-, or tetra-allelic, the vast majority of the SNPs are bi-allelic, and are thus often referred to as "bi-allelic markers", or "di-allelic markers".

As used herein, references to SNPs and SNP genotypes include individual SNPs and/or haplotypes, which are groups of SNPs that are generally inherited together. Haplotypes can have stronger correlations with diseases or other phenotypic effects compared with individual SNPs, and therefore may provide increased diagnostic accuracy in some cases (Stephens et al. *Science* 293, 489-493, 20 Jul. 2001). As used herein, the term "haplotype" refers to a set of two or more alleles on a single chromosome. The term "diplotype" refers to a combination of two haplotypes that a diploid individual carries. The term "double diplotype", also called "two-locus diplotype", refers to a combination of diplotypes at two distinct loci for an individual.

Causative SNPs are those SNPs that produce alterations in gene expression or in the expression, structure, and/or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a SNP within a coding sequence causes a genetic disease include sickle cell anemia and cystic fibrosis.

Causative SNPs do not necessarily have to occur in coding regions; causative SNPs can occur in, for example, any genetic region that can ultimately affect the expression, structure, and/or activity of the protein encoded by a nucleic acid. Such genetic regions include, for example, those involved in transcription, such as SNPs in transcription factor binding domains, SNPs in promoter regions, in areas involved in transcript processing, such as SNPs at intron-exon boundaries that may cause defective splicing, or SNPs in mRNA processing signal sequences such as polyadenylation signal regions. Some SNPs that are not causative SNPs nevertheless are in close association with, and therefore segregate with, a disease-causing sequence In this situation, the presence of a SNP correlates with the presence of, or predisposition to, or an increased risk in developing the disease. These SNPs, although not causative, are nonetheless also useful for diagnostics, disease predisposition screening, and other uses.

An association study of a SNP and a specific disorder involves determining the presence or frequency of the SNP allele in biological samples from individuals with the disorder of interest, such as psoriasis and related pathologies and comparing the information to that of controls (i.e., individuals who do not have the disorder; controls may be also referred to as "healthy" or "normal" individuals) who are preferably of similar age and race. The appropriate selection of patients and controls is important to the success of SNP association studies. Therefore, a pool of individuals with well-characterized phenotypes is extremely desirable.

A SNP may be screened in diseased tissue samples or any biological sample obtained from a diseased individual, and compared to control samples, and selected for its increased (or decreased) occurrence in a specific pathological condition, such as pathologies related to psoriasis, increased or decreased risk of developing psoriasis. Once a statistically significant association is established between one or more SNP(s) and a pathological condition (or other phenotype) of interest, then the region around the SNP can optionally be thoroughly screened to identify the causative genetic locus/ sequence(s) (e.g., causative SNP/mutation, gene, regulatory region, etc.) that influences the pathological condition or phenotype. Association studies may be conducted within the general population and are not limited to studies performed on related individuals in affected families (linkage studies).

Clinical trials have shown that patient response to treatment with pharmaceuticals is often heterogeneous. There is a continuing need to improve pharmaceutical agent design and therapy. In that regard, SNPs can be used to identify patients most suited to therapy with particular pharmaceutical agents (this is often termed "pharmacogenomics"). Similarly, SNPs can be used to exclude patients from certain treatment due to the patient's increased likelihood of developing toxic side effects or their likelihood of not responding to the treatment. Pharmacogenomics can also be used in pharmaceutical research to assist the drug development and selection process. (Linder et al. (1997), *Clinical Chemistry*, 43, 254; Marshall (1997), *Nature Biotechnology*, 15, 1249; International Patent Application WO 97/40462, Spectra Biomedical; and Schafer et al. (1998), *Nature Biotechnology*, 16: 3).

SUMMARY OF THE INVENTION

The present invention relates to the identification of novel SNPs, unique combinations of such SNPs, haplotypes or diplotypes of SNPs that are associated with psoriasis and in particular the increased or decreased risk of developing psoriasis. The polymorphisms disclosed herein are directly useful as targets for the design of diagnostic reagents and the development of therapeutic agents for use in the diagnosis and treatment of psoriasis and related pathologies.

Based on the identification of SNPs associated with psoriasis, the present invention also provides methods of detecting these variants as well as the design and preparation of detection reagents needed to accomplish this task. The invention specifically provides, for example, novel SNPs in genetic sequences involved in psoriasis and related pathologies, isolated nucleic acid molecules (including, for example, DNA and RNA molecules) containing these SNPs, variant proteins encoded by nucleic acid molecules containing such SNPs, antibodies to the encoded variant proteins, computer-based and data storage systems containing the novel SNP information, methods of detecting these SNPs in a test sample, methods of identifying individuals who have an altered (i.e., increased or decreased) risk of developing psoriasis based on the presence or absence of one or more particular nucleotides (alleles) at one or more SNP sites disclosed herein or the detection of one or more encoded variant products (e.g., variant mRNA transcripts or variant proteins), methods of identifying individuals who are more or less likely to respond to a treatment (or more or less likely to experience undesirable side effects from a treatment, etc.), methods of screening for compounds useful in the treatment of a disorder associated with a variant gene/protein, compounds identified by these methods, methods of treating disorders mediated by a variant gene/protein, methods of using the novel SNPs of the present invention for human identification, etc.

In Tables 1-2, the present invention provides gene information, transcript sequences (SEQ ID NOS: 1-3), encoded amino acid sequences (SEQ ID NOS:4-6), genomic sequences (SEQ ID NOS:13-23), transcript-based context sequences (SEQ ID NOS:7-12) and genomic-based context sequences (SEQ ID NOS:24-89) that contain the SNPs of the present invention, and extensive SNP information that includes observed alleles, allele frequencies, populations/ethnic groups in which alleles have been observed, information about the type of SNP and corresponding functional effect, and, for cSNPs, information about the encoded polypeptide product. The transcript sequences (SEQ ID NOS:1-3), amino acid sequences (SEQ ID NOS:4-6), genomic sequences (SEQ ID NOS:13-23), transcript-based SNP context sequences (SEQ ID NOS: 7-12), and genomic-based SNP context sequences (SEQ ID NOS:24-89) are also provided in the Sequence Listing.

In a specific embodiment of the present invention, SNPs that occur naturally in the human genome are provided as isolated nucleic acid molecules. These SNPs are associated with psoriasis and related pathologies. In particular the SNPs are associated with either an increased or decreased risk of developing psoriasis. As such, they can have a variety of uses in the diagnosis and/or treatment of psoriasis and related pathologies. One aspect of the present invention relates to an isolated nucleic acid molecule comprising a nucleotide sequence in which at least one nucleotide is a SNP that is propriatory to Applera, or Celera. In an alternative embodiment, a nucleic acid of the invention is an amplified polynucleotide, which is produced by amplification of a SNP-containing nucleic acid template. In another embodiment, the invention provides for a variant protein that is encoded by a nucleic acid molecule containing a SNP disclosed herein.

In yet another embodiment of the invention, a reagent for detecting a SNP in the context of its naturally-occurring flanking nucleotide sequences (which can be, e.g., either DNA or mRNA) is provided. In particular, such a reagent may be in the form of, for example, a hybridization probe or an amplification primer that is useful in the specific detection of a SNP of interest. In an alternative embodiment, a protein detection reagent is used to detect a variant protein that is encoded by a nucleic acid molecule containing a SNP disclosed herein. A preferred embodiment of a protein detection reagent is an antibody or an antigen-reactive antibody fragment.

Various embodiments of the invention also provide kits comprising SNP detection reagents, and methods for detecting the SNPs disclosed herein by employing detection reagents. In a specific embodiment, the present invention provides for a method of identifying an individual having an increased or decreased risk of developing psoriasis by detecting the presence or absence of one or more SNP alleles disclosed herein. Preferably, the SNP allele can be an allele of a SNP selected from the group consisting of rs321227, rs3212220, rs7709212, and rs6887695, or a combination of any number of them.

In another embodiment, a method for diagnosis of psoriasis and related pathologies by detecting the presence or absence of one or more SNP alleles disclosed herein is provided. In another embodiment, the invention provides for a method of identifying an individual having an altered (either increased, or, decreased) risk of developing psoriasis by detecting the presence or absence of one or more SNP haplotypes, diplotypes, or two-locus diplotypes disclosed herein.

The SNP haplotype herein can be, for example, a combination of rs3212227(A) and rs6887695(G), as a risk haplotype. The SNP haplotype herein can also be, for example, a combination of rs3212227(C) and rs6887695(C), as a protective haplotype. The SNP haplotype herein can also be, for example, a combination of rs11209026(G) and rs 7530511 (C), which is a risk haplotype.

The SNP diplotype is preferably a combination of two copies of the risk haplotype, rs3212227(A)/rs6887695(G). The SNP diplotype is also preferably a combination of two copies of the protective haplotype, rs3212227(C)/rs6887695 (C). Similarly, the SNP diplotype can be a combination of two copies of the risk haplotype rs11209026(G) and rs 7530511 (C).

Furthermore, an exemplary embodiment of the present invention provides for a method of identifying an individual having an increased risk of developing psoriasis by detecting the presence of absence of one or more two-locus diplotypes. Preferably, the two-locus diplotype herein can be a combination of rs3212227(A)/rs6887695(G)/rs11209026(G)/rs 7530511(C).

The nucleic acid molecules of the invention can be inserted in an expression vector, such as to produce a variant protein in a host cell. Thus, the present invention also provides for a vector comprising a SNP-containing nucleic acid molecule, genetically-engineered host cells containing the vector, and methods for expressing a recombinant variant protein using such host cells. In another specific embodiment, the host cells, SNP-containing nucleic acid molecules, and/or variant proteins can be used as targets in a method for screening and identifying therapeutic agents or pharmaceutical compounds useful in the treatment of psoriasis and related pathologies.

An aspect of this invention is a method for treating psoriasis in a human subject wherein said human subject harbors a SNP, gene, transcript, and/or encoded protein identified in Tables 1-2, which method comprises administering to said human subject a therapeutically or prophylactically effective amount of one or more agents counteracting the effects of the disease, such as by inhibiting (or stimulating) the activity of the gene, transcript, and/or encoded protein identified in Tables 1-2.

Another aspect of this invention is a method for identifying an agent useful in therapeutically or prophylactically treating psoriasis and related pathologies in a human subject wherein said human subject harbors a SNP, gene, transcript, and/or encoded protein identified in Tables 1-2, which method comprises contacting the gene, transcript, or encoded protein with a candidate agent under conditions suitable to allow formation of a binding complex between the gene, transcript, or encoded protein and the candidate agent and detecting the formation of the binding complex, wherein the presence of the complex identifies said agent.

Another aspect of this invention is a method for treating psoriasis and related pathologies in a human subject, which method comprises:

(i) determining that said human subject harbors a SNP, gene, transcript, and/or encoded protein identified in Tables 1-2, and (ii) administering to said subject a therapeutically or prophylactically effective amount of one or more agents counteracting the effects of the disease.

Yet another aspect of this invention is a method for evaluating the suitability of a patient for psoriasis treatment comprising determining the genotype of said patient with respect to a particular set of SNP markers, said SNP markers comprising a plurality of individual SNPs ranging from two to seven SNPs in Table 1 or Table 2, and calculating a score using an appropriate algorithm based on the genotype of said patient, the resulting score being indicative of the suitability of said patient undergoing psoriasis treatment.

Another aspect of the invention is a method of treating a psoriasis patient comprising administering an appropriate drug in a therapeutically effective amount to said psoriasis patient whose genotype has been shown to contain a plurality of SNPs as described in Table 1 or Table 2.

Many other uses and advantages of the present invention will be apparent to those skilled in the art upon review of the detailed description of the preferred embodiments herein.

Solely for clarity of discussion, the invention is described in the sections below by way of non-limiting examples.

Description of the Files Contained on the CD-R Named CD000011ORD-CDR

The CD-R named CD000011ORD-CDR contains the following five text (ASCII) files:

1) File SEQLIST_CD000011PRO.txt provides the Sequence Listing. The Sequence Listing provides the transcript sequences (SEQ ID NOS:1-3) and protein sequences (SEQ ID NOS:4-6) as shown in Table 1, and genomic sequences (SEQ ID NOS:13-23) as shown in Table 2, for each psoriasis-associated gene that contains one or more SNPs of the present invention. Also provided in the Sequence Listing are context sequences flanking each SNP, including both transcript-based context sequences as shown in Table 1 (SEQ ID NOS:7-12) and genomic-based context sequences as shown in Table 2 (SEQ ID NOS:24-89). The context sequences generally provide 100 bp upstream (5') and 100 bp downstream (3') of each SNP, with the SNP in the middle of the context sequence, for a total of 200 bp of context sequence surrounding each SNP. File SEQLIST_CD000011ORD.txt is 1,240 KB in size, and was created on Aug. 28, 2007.

The material contained on the CD-R labeled CRF is hereby incorporated by reference pursuant to 37 CFR 1.77(b)(4).

Description of Table 1 and Table 2

Table 1 and Table 2 (both provided on the CD-R) disclose the SNP and associated gene/transcript/protein information of the present invention. For each gene, Table 1 and Table 2 each provide a header containing gene/transcript/protein information, followed by a transcript and protein sequence (in Table 1) or genomic sequence (in Table 2), and then SNP information regarding each SNP found in that gene/transcript.

NOTE: SNPs may be included in both Table 1 and Table 2; Table 1 presents the SNPs relative to their transcript sequences and encoded protein sequences, whereas Table 2 presents the SNPs relative to their genomic sequences (in some instances Table 2 may also include, after the last gene sequence, genomic sequences of one or more intergenic regions, as well as SNP context sequences and other SNP information for any SNPs that lie within these intergenic regions). SNPs can readily be cross-referenced between Tables based on their hCV (or, in some instances, hDV) identification numbers.

The gene/transcript/protein information includes:
- a gene number (1 through n, where n=the total number of genes in the Table)
- a Celera hCG and UID internal identification numbers for the gene
- a Celera hCT and UID internal identification numbers for the transcript (Table 1 only)
- a public Genbank accession number (e.g., RefSeq NM number) for the transcript (Table 1 only)
- a Celera hCP and UID internal identification numbers for the protein encoded by the hCT transcript (Table 1 only)
- a public Genbank accession number (e.g., RefSeq NP number) for the protein (Table 1 only)
- an art-known gene symbol
- an art-known gene/protein name
- Celera genomic axis position (indicating start nucleotide position-stop nucleotide position)
- the chromosome number of the chromosome on which the gene is located
- an OMIM (Online Mendelian Inheritance in Man; Johns Hopkins University/NCBI) public reference number for obtaining further information regarding the medical significance of each gene
- alternative gene/protein name(s) and/or symbol(s) in the OMIM entry NOTE: Due to the presence of alternative splice forms, multiple transcript/protein entries can be provided for a single gene entry in Table 1; i.e., for a single Gene Number, multiple entries may be provided in series that differ in their transcript/protein information and sequences.

Following the gene/transcript/protein information is a transcript sequence and protein sequence (in Table 1), or a genomic sequence (in Table 2), for each gene, as follows:
- transcript sequence (Table 1 only) (corresponding to SEQ ID NOS:1-3 of the Sequence Listing), with SNPs identified by their IUB codes (transcript sequences can include 5' UTR, protein coding, and 3' UTR regions). (NOTE: If there are differences between the nucleotide sequence of the hCT transcript and the corresponding public transcript sequence identified by the Genbank accession number, the hCT transcript sequence (and encoded protein) is provided, unless the public sequence is a RefSeq transcript sequence identified by an NM number, in which case the RefSeq NM transcript sequence (and encoded protein) is provided. However, whether the hCT transcript or RefSeq NM transcript is used as the transcript sequence, the disclosed SNPs are represented by their IUB codes within the transcript.)
- the encoded protein sequence (Table 1 only) (corresponding to SEQ ID NOS:4-6 of the Sequence Listing)
- the genomic sequence of the gene (Table 2 only), including 6 kb on each side of the gene boundaries (i.e., 6 kb on the 5' side of the gene plus 6 kb on the 3' side of the gene) (corresponding to SEQ ID NOS:13-23 of the Sequence Listing).

After the last gene sequence, Table 2 may include additional genomic sequences of intergenic regions (in such instances, these sequences are identified as "Intergenic region:" followed by a numerical identification number), as well as SNP context sequences and other SNP information for any SNPs that lie within each intergenic region (and such SNPs are identified as "INTERGENIC" for SNP type).

NOTE: The transcript, protein, and transcript-based SNP context sequences are provided in both Table 1 and in the Sequence Listing. The genomic and genomic-based SNP context sequences are provided in both Table 2 and in the Sequence Listing. SEQ ID NOS are indicated in Table 1 for each transcript sequence (SEQ ID NOS:1-3), protein sequence (SEQ ID NOS:4-6), and transcript-based SNP context sequence (SEQ ID NOS:7-12), and SEQ ID NOS are indicated in Table 2 for each genomic sequence (SEQ ID NOS:13-23), and genomic-based SNP context sequence (SEQ ID NOS:24-89).

The SNP information includes:
- context sequence (taken from the transcript sequence in Table 1, and taken from the genomic sequence in Table 2) with the SNP represented by its IUB code, including 100 bp upstream (5') of the SNP position plus 100 bp downstream (3') of the SNP position (the transcript-based SNP context sequences in Table 1 are provided in the Sequence Listing as SEQ ID NOS:7-12; the genomic-based SNP context sequences in Table 2 are provided in the Sequence Listing as SEQ ID NOS:24-89).
- Celera hCV internal identification number for the SNP (in some instances, an "hDV" number is given instead of an "hCV" number)
- SNP position [position of the SNP within the given transcript sequence (Table 1) or within the given genomic sequence (Table 2)]

SNP source (may include any combination of one or more of the following five codes, depending on which internal sequencing projects and/or public databases the SNP has been observed in: "Applera"=SNP observed during the re-sequencing of genes and regulatory regions of 39 individuals, "Celera"=SNP observed during shotgun sequencing and assembly of the Celera human genome sequence, "Celera Diagnostics"=SNP observed during re-sequencing of nucleic acid samples from individuals who have a disease, "dbSNP"=SNP observed in the dbSNP public database, "HGBASE"=SNP observed in the HGBASE public database, "HGMD"=SNP observed in the Human Gene Mutation Database (HGMD) public database, "HapMap"=SNP observed in the International HapMap Project public database, "CSNP"=SNP observed in an internal Applied Biosystems (Foster City, Calif.) database of coding SNPS (cSNPs)) (NOTE: multiple "Applera" source entries for a single SNP indicate that the same SNP was covered by multiple overlapping amplification products and the re-sequencing results (e.g., observed allele counts) from each of these amplification products is being provided)

Population/allele/allele count information in the format of [population1(first_allele,count|second_allele,count) population2(first_allele,count|second_allele,count) total (first_allele,total count|second_allele,total count)]. The information in this field includes populations/ethnic groups in which particular SNP alleles have been observed ("cau"=Caucasian, "his"=Hispanic, "chn"=Chinese, and "afr"=African-American, "jpn"=Japanese, "ind"=Indian, "mex"=Mexican, "ain"="American Indian", "cra"=Celera donor, "no_pop"=no population information available), identified SNP alleles, and observed allele counts (within each population group and total allele counts), where available ["-" in the allele field represents a deletion allele of an insertion/deletion ("indel") polymorphism (in which case the corresponding insertion allele, which may be comprised of one or more nucleotides, is indicated in the allele field on the opposite side of the "|"); "-" in the count field indicates that allele count information is not available]. For certain SNPs from the public dbSNP database, population/ethnic information is indicated as follows (this population information is publicly available in dbSNP): "HISP1"=human individual DNA (anonymized samples) from 23 individuals of self-described HISPANIC heritage; "PAC1"=human individual DNA (anonymized samples) from 24 individuals of self-described PACIFIC RIM heritage; "CAUC1"=human individual DNA (anonymized samples) from 31 individuals of self-described CAUCASIAN heritage; "AFR1"=human individual DNA (anonymized samples) from 24 individuals of self-described AFRICAN/AFRICAN AMERICAN heritage; "P1"=human individual DNA (anonymized samples) from 102 individuals of self-described heritage; "PA130299515"; "SC_12_A"=SANGER 12 DNAs of Asian origin from Corielle cell repositories, 6 of which are male and 6 female; "SC_12_C"=SANGER 12 DNAs of Caucasian origin from Corielle cell repositories from the CEPH/UTAH library. Six male and 6 female; "SC_12_AA"=SANGER 12 DNAs of African-American origin from Corielle cell repositories 6 of which are male and 6 female; "SC_95_C"=SANGER 95 DNAs of Caucasian origin from Corielle cell repositories from the CEPH/UTAH library; and "SC_12_CA"=Caucasians—12 DNAs from Corielle cell repositories that are from the CEPH/UTAH library. Six male and 6 female.

NOTE: For SNPs of "Applera" SNP source, genes/regulatory regions of 39 individuals (20 Caucasians and 19 African Americans) were re-sequenced and, since each SNP position is represented by two chromosomes in each individual (with the exception of SNPs on X and Y chromosomes in males, for which each SNP position is represented by a single chromosome), up to 78 chromosomes were genotyped for each SNP position. Thus, the sum of the African-American ("afr") allele counts is up to 38, the sum of the Caucasian allele counts ("cau") is up to 40, and the total sum of all allele counts is up to 78.

(NOTE: semicolons separate population/allele/count information corresponding to each indicated SNP source; i.e., if four SNP sources are indicated, such as "Celera", "dbSNP", "HGBASE", and "HGMD", then population/allele/count information is provided in four groups which are separated by semicolons and listed in the same order as the listing of SNP sources, with each population/allele/count information group corresponding to the respective SNP source based on order; thus, in this example, the first population/allele/count information group would correspond to the first listed SNP source (Celera) and the third population/allele/count information group separated by semicolons would correspond to the third listed SNP source (HGBASE); if population/allele/count information is not available for any particular SNP source, then a pair of semicolons is still inserted as a place-holder in order to maintain correspondence between the list of SNP sources and the corresponding listing of population/allele/count information)

SNP type (e.g., location within gene/transcript and/or predicted functional effect) ["MIS-SENSE MUTATION"=SNP causes a change in the encoded amino acid (i.e., a non-synonymous coding SNP); "SILENT MUTATION"=SNP does not cause a change in the encoded amino acid (i.e., a synonymous coding SNP); "STOP CODON MUTATION"=SNP is located in a stop codon; "NONSENSE MUTATION"=SNP creates or destroys a stop codon; "UTR 5"=SNP is located in a 5' UTR of a transcript; "UTR 3"=SNP is located in a 3' UTR of a transcript; "PUTATIVE UTR 5"=SNP is located in a putative 5' UTR; "PUTATIVE UTR 3"=SNP is located in a putative 3' UTR; "DONOR SPLICE SITE"=SNP is located in a donor splice site (5' intron boundary); "ACCEPTOR SPLICE SITE"=SNP is located in an acceptor splice site (3' intron boundary); "CODING REGION"=SNP is located in a protein-coding region of the transcript; "EXON"=SNP is located in an exon; "INTRON"=SNP is located in an intron; "hmCS"=SNP is located in a human-mouse conserved segment; "TFBS"=SNP is located in a transcription factor binding site; "UNKNOWN"=SNP type is not defined; "INTERGENIC"=SNP is intergenic, i.e., outside of any gene boundary]

Protein coding information (Table 1 only), where relevant, in the format of [protein SEQ ID NO:#, amino acid position, (amino acid-1, codon1) (amino acid-2, codon2)]. The information in this field includes SEQ ID NO of the encoded protein sequence, position of the amino acid residue within the protein identified by the SEQ ID NO that is encoded by the codon containing the SNP, amino acids (represented by one-letter amino acid codes) that are encoded by the alternative SNP alleles (in the case of stop codons, "X" is used for the one-letter amino acid code), and alternative codons containing the alternative SNP nucleotides which encode the amino acid residues (thus, for example, for missense mutation-type SNPs, at least two different amino acids and at least two different codons are generally indicated; for silent mutation-type SNPS, one amino acid and at least two different codons are generally indicated, etc.). In instances where the SNP is located outside of a protein-coding region (e.g., in a UTR region), "None" is indicated following the protein SEQ ID NO.

Description of Table 3

Table 3 provides sequences (SEQ ID NOS:90-200) of primers that have been synthesized and used in the laboratory to assay certain SNPs by allele-specific PCR during the course of association studies to verify the association of these SNPs with psoriasis (see Examples section).

Table 3 provides the following:
the column labeled "Marker" provides an identification number (e.g., a public "rs" number or internal "hCV" number) for each SNP site.
the column labeled "Alleles" designates the two alternative alleles (i.e., nucleotides) at the SNP site. These alleles are targeted by the allele-specific primers (the allele-specific primers are shown as Primer 1 and Primer 2). Note that alleles may be presented in Table 3 based on a different orientation (i.e., the reverse complement) relative to how the same alleles are presented in Tables 1-2.
the column labeled "Primer 1 (Allele-Specific Primer)" provides an allele-specific primer that is specific for an allele designated in the "Alleles" column.
the column labeled "Primer 2 (Allele-Specific Primer)" provides an allele-specific primer that is specific for the other allele designated in the "Alleles" column.
the column labeled "Common Primer" provides a common primer that is used in conjunction with each of the allele-specific primers (i.e., Primer 1 and Primer 2) and which hybridizes at a site away from the SNP position.

All primer sequences are given in the 5' to 3' direction.

Each of the nucleotides designated in the "Alleles" column matches or is the reverse complement of (depending on the orientation of the primer relative to the designated allele) the 3' nucleotide of the allele-specific primer (i.e., either Primer 1 or Primer 2) that is specific for that allele.

Description of Table 4

Table 4 provides a list of LD SNPs that are related to and derived from certain interrogated SNPs. The interrogated SNPs, which are shown in column 1 (which indicates the hCV identification numbers of each interrogated SNP) and column 2 (which indicates the public rs identification numbers of each interrogated SNP) of Table 4, are statistically significantly associated with psoriasis as shown in the tables. These LD SNPs are provided as an example of SNPs which can also serve as markers for disease association based on their being in LD with an interrogated SNP. The criteria and process of selecting such LD SNPs, including the calculation of the $r^2$ value and the $r^2$ threshold value, are described in Example Four, below.

In Table 4, the column labeled "Interrogated SNP" presents each marker as identified by its unique hCV identification number. The column labeled "Interrogated rs" presents the publicly known identifier rs number for the corresponding hCV number. The column labeled "LD SNP" presents the hCV numbers of the LD SNPs that are derived from their corresponding interrogated SNPs. The column labeled "LD SNP rs" presents the publicly known rs number for the corresponding hCV number. The column labeled "Power" presents the level of power where the $r^2$ threshold is set. For example, when power is set at 0.51, the threshold $r^2$ value calculated therefrom is the minimum $r^2$ that an LD SNP must have in reference to an interrogated SNP, in order for the LD SNP to be classified as a marker capable of being associated with a disease phenotype at greater than 51% probability. The column labeled "Threshold $r^2$" presents the minimum value of $r^2$ that an LD SNP must meet in reference to an interrogated SNP in order to qualify as an LD SNP. The column labeled "$r^2$" presents the actual $r^2$ value of the LD SNP in reference to the interrogated SNP to which it is related.

Description of Tables 5-22

Table 5 provides IL12B and IL23R region SNPs that are significant in a combined analysis across all three sample sets (the 95% confidence intervals for the odds ratios do not cross 1).

Table 6 provides minor allele frequencies and allele-based association of IL12B-associated SNPs with psoriasis.

Table 7 provides minor allele frequencies and allele-based association of IL23R-associated SNPs with psoriasis.

Table 8 provides demographic, clinical, and pooling information for certain samples used in the analyses, including the discovery sample set and the replication sample set 1.

Table 9 provides allele frequencies and allele-based association of 32 SNPs with psoriasis using pooled DNAs.

Table 10 provides results of case-control analysis for rs3212227.

Table 11 provides minor allele frequencies and allele-based association of IL12B-associated SNPs with psoriasis.

Table 12 provides two marker haplotypes for the IL12B region.

Table 13 provides three marker IL12B haplotypes including the putative promoter polymorphism, ss52085993.

Table 14 provides allele frequencies and allele-based association of markers in IL12B-related genes.

Table 15 provides two marker haplotypes for the IL23R gene.

Table 16 provides results of diplotype analysis for the IL12B SNPs rs3212227 and rs6887695.

Table 17 provides results of diplotype analysis for the IL23R SNPs rs7530511 and rs11209026.

Table 18 provides two-locus diplotypes for IL12B and IL23R.

Table 19 provides genotype frequencies for certain significantly associated SNPs across sample sets.

Table 20 provides effect sizes for haplotypes at rs7530511-rs11209026-rs10889674.

Table 21 provides IL23R region sliding window haplotype association 3-SNP windows.

Table 22 provides therapeutic agents that target IL12 or IL23 which are in active clinical development programs.

Throughout Tables 5-7 and 9-21, "OR" refers to the odds ratio, "95% CI" refers to the 95% confidence interval for the odds ratio, and $OR_{common}$ and $P_{comb}$ refer to the odds ratio and p-value, respectively, from a combined analysis.

Odds ratios (OR) greater than one indicate that a given allele (or combination of alleles such as a haplotype, diplotype, or two-locus diplotype) is a risk allele, whereas odds ratios less than one indicate that a given allele is a non-risk allele (which may also be referred to as a protective allele). For a given risk allele, the other alternative allele at the SNP position may be considered a non-risk (i.e., protective) allele. For a given non-risk (i.e., protective) allele, the other alternative allele at the SNP position may be considered a risk allele.

DETAILED DESCRIPTION OF THE INVENTION

The present invention provides SNPs associated with psoriasis and related pathologies, nucleic acid molecules containing SNPs, methods and reagents for the detection of the SNPs disclosed herein, uses of these SNPs for the development of detection reagents, and assays or kits that utilize such reagents. The psoriasis-associated SNPs disclosed herein are useful for diagnosing, screening for, and evaluating predisposition to psoriasis, including an increased or decreased risk of developing psoriasis, the rate of progression of psoriasis, and related pathologies in humans. Furthermore, such SNPs and their encoded products are useful targets for the development of therapeutic agents.

A large number of SNPs have been identified from re-sequencing DNA from 39 individuals, and they are indicated as "Applera" SNP source in Tables 1-2. Their allele frequencies observed in each of the Caucasian and African-American ethnic groups are provided. Additional SNPs included herein were previously identified during shotgun sequencing and assembly of the human genome, and they are indicated as "Celera" SNP source in Tables 1-2. Furthermore, the information provided in Table 1-2, particularly the allele frequency information obtained from 39 individuals and the identification of the precise position of each SNP within each gene/transcript, allows haplotypes (i.e., groups of SNPs that are co-inherited) to be readily inferred. The present invention encompasses SNP haplotypes, as well as individual SNPs.

Thus, the present invention provides individual SNPs associated with psoriasis, as well as combinations of SNPs and haplotypes in genetic regions associated with psoriasis, polymorphic/variant transcript sequences (SEQ ID NOS:1-3) and genomic sequences (SEQ ID NOS:13-23) containing SNPs, encoded amino acid sequences (SEQ ID NOS: 4-6), and both transcript-based SNP context sequences (SEQ ID NOS: 7-12) and genomic-based SNP context sequences (SEQ ID NOS: 24-89) (transcript sequences, protein sequences, and transcript-based SNP context sequences are provided in Table 1 and the Sequence Listing; genomic sequences and genomic-based SNP context sequences are provided in Table 2 and the Sequence Listing), methods of detecting these polymorphisms in a test sample, methods of determining the risk of an individual of having or developing psoriasis, methods of screening for compounds useful for treating disorders associated with a variant gene/protein such as psoriasis, compounds identified by these screening methods, methods of using the disclosed SNPs to select a treatment strategy, methods of treating a disorder associated with a variant gene/protein (i.e., therapeutic methods), and methods of using the SNPs of the present invention for human identification.

The present invention provides novel SNPs associated with psoriasis and related pathologies, as well as SNPs that were previously known in the art, but were not previously known to be associated with psoriasis. Accordingly, the present invention provides novel compositions and methods based on the novel SNPs disclosed herein, and also provides novel methods of using the known, but previously unassociated, SNPs in methods relating to psoriasis (e.g., for diagnosing psoriasis, etc.). In Tables 1-2, known SNPs are identified based on the public database in which they have been observed, which is indicated as one or more of the following SNP types: "dbSNP"=SNP observed in dbSNP, "HGBASE"=SNP observed in HGBASE, and "HGMD"=SNP observed in the Human Gene Mutation Database (HGMD). Novel SNPs for which the SNP source is only "Applera" and none other, i.e., those that have not been observed in any public databases and which were also not observed during shotgun sequencing and assembly of the Celera human genome sequence (i.e., "Celera" SNP source), are indicated in the tables.

Particular SNP alleles of the present invention can be associated with either an increased risk of having or developing psoriasis and related pathologies, or a decreased risk of having or developing psoriasis. SNP alleles that are associated with a decreased risk of having or developing psoriasis may be referred to as "protective" alleles, and SNP alleles that are associated with an increased risk of having or developing psoriasis may be referred to as "susceptibility" alleles, "risk" alleles, or "risk factors". Thus, whereas certain SNPs (or their encoded products) can be assayed to determine whether an individual possesses a SNP allele that is indicative of an increased risk of having or developing psoriasis (i.e., a susceptibility allele), other SNPs (or their encoded products) can be assayed to determine whether an individual possesses a SNP allele that is indicative of a decreased risk of having or developing psoriasis (i.e., a protective allele). Similarly, particular SNP alleles of the present invention can be associated with either an increased or decreased likelihood of responding to a particular treatment or therapeutic compound, or an increased or decreased likelihood of experiencing toxic effects from a particular treatment or therapeutic compound. The term "altered" may be used herein to encompass either of these two possibilities (e.g., an increased or a decreased risk/likelihood).

Those skilled in the art will readily recognize that nucleic acid molecules may be double-stranded molecules and that reference to a particular site on one strand refers, as well, to the corresponding site on a complementary strand. In defining a SNP position, SNP allele, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference may be made to either strand in order to refer to a particular SNP position, SNP allele, or nucleotide sequence. Probes and primers, may be designed to hybridize to either strand and SNP genotyping methods disclosed herein may generally target either strand. Throughout the specification, in identifying a SNP position, reference is generally made to the protein-encoding strand, only for the purpose of convenience.

References to variant peptides, polypeptides, or proteins of the present invention include peptides, polypeptides, proteins, or fragments thereof, that contain at least one amino acid residue that differs from the corresponding amino acid sequence of the art-known peptide/polypeptide/protein (the art-known protein may be interchangeably referred to as the "wild-type", "reference", or "normal" protein). Such variant peptides/polypeptides/proteins can result from a codon change caused by a nonsynonymous nucleotide substitution at a protein-coding SNP position (i.e., a missense mutation) disclosed by the present invention. Variant peptides/polypeptides/proteins of the present invention can also result from a nonsense mutation, i.e., a SNP that creates a premature stop codon, a SNP that generates a read-through mutation by abolishing a stop codon, or due to any SNP disclosed by the present invention that otherwise alters the structure, function/activity, or expression of a protein, such as a SNP in a regulatory region (e.g. a promoter or enhancer) or a SNP that leads to alternative or defective splicing, such as a SNP in an intron or a SNP at an exon/intron boundary. As used herein, the terms "polypeptide", "peptide", and "protein" are used interchangeably.

IL12 and IL23 Therapeutics/Pharmacogenomics in Inflammatory and Autoimmune Disorders Exemplary embodiments of the invention provide SNPs in IL12 and IL23 that are associated with psoriasis (as shown in the tables). These SNPs have a variety of therapeutic and pharmacogenomic uses related to the treatment of psoriasis, as well as other inflammatory and autoimmune disorders such as Crohn's disease, ulcerative colitis, ankylosing spondylitis, rheumatoid arthritis, and multiple sclerosis. The psoriasis-associated SNPs provided herein may be used, for example, to determine variability between different individuals in their response to an inflammatory or autoimmune disease therapy (e.g., a psoriasis therapy or a therapy for Crohn's disease, ulcerative colitis, ankylosing spondylitis, rheumatoid arthritis, multiple sclerosis, or other inflammatory or autoimmune disorder) such as to predict whether an individual will respond positively to a particular therapy, to determine the most effective therapeutic agent (e.g., antibody, small molecule compound, nucleic acid agent, etc.) to use to treat an individual, to determine whether a particular therapeutic agent should or should not be administered to an individual (e.g., by predicting whether the individual is likely to positively respond to the therapy or by predicting whether the individual will experience toxic or other undesirable side effects or is unlikely to respond to the therapy), or to determine the therapeutic regimen to use for an individual such as the dosage or frequency of dosing of a therapeutic agent for a particular individual. For example, Table 22 provides examples of therapeutic agents in clinical development that target IL12 or IL23 which the SNPs provided herein can be used in conjunction with. The therapeutic agents provided in Table 22 are examples of therapeutic agents that may be used to treat psoriasis or other inflammatory or autoimmune disorders, such as by modulating (e.g., inhibiting or stimulating) IL12 or IL23. Therapeutic agents that directly modulate IL12 or IL23 may be used to treat psoriasis or other inflammatory/autoimmune disorders and, furthermore, therapeutic agents that target proteins that interact with IL12 or IL23 or are otherwise in IL12 or IL23 pathways may be used to indirectly modulate IL12 or IL23 to thereby treat psoriasis or other inflammatory/autoimmune disorders. Any therapeutic agents such as these may be used in conjunction with the SNPs provided herein.

As one specific example, the IL12B and IL23R psoriasis-associated SNPs provided herein may be used to predict whether an individual will respond positively to anti-IL-12p40 antibody therapy and/or to determine the most effective dosage of this therapy. This facilitates decision making by medical practitioners, such as in deciding whether to administer this therapy to a particular individual or select another therapy that may be better suited to the individual, or to use a particular dosage, dosing schedule, or to modify other aspects of a therapeutic regimen to effectively treat the individual, for example.

In addition to medical treatment, these uses may also be applied, for example, in the context of clinical trials of a therapeutic agent (e.g., a therapeutic agent that targets IL12 or IL23 for the treatment of psoriasis, Crohn's disease, ulcerative colitis, ankylosing spondylitis, rheumatoid arthritis, multiple sclerosis, or other inflammatory or autoimmune disorders), such as to include particular individuals in a clinical trial who are predicted to positively respond to the therapeutic agent based on the SNPs provided herein and/or to exclude particular individuals from a clinical trial who are predicted to not positively respond to the therapeutic agent based on the SNPs provided herein. By using the SNPs provided herein to target a therapeutic agent to individuals who are more likely to positively respond to the agent, the therapeutic agent is more likely to succeed in clinical trials by showing positive efficacy and to therefore satisfy the FDA requirements for approval. Additionally, individuals who are more likely to experience toxic or other undesirable side effects may be excluded from being administered the therapeutic agent. Furthermore, by using the SNPs provided herein to determine an effective dosage or dosing frequency, for example, the therapeutic agent may be less likely to exhibit toxicity or other undesirable side effects, as well as more likely to achieve positive efficacy.

Isolated Nucleic Acid Molecules and SNP Detection Reagents & Kits

Tables 1 and 2 provide a variety of information about each SNP of the present invention that is associated with psoriasis, including the transcript sequences (SEQ ID NOS:1-3), genomic sequences (SEQ ID NOS:13-23), and protein sequences (SEQ ID NOS:4-6) of the encoded gene products (with the SNPs indicated by IUB codes in the nucleic acid sequences). In addition, Tables 1 and 2 include SNP context sequences, which generally include 100 nucleotide upstream (5') plus 100 nucleotides downstream (3') of each SNP position (SEQ ID NOS:7-12 correspond to transcript-based SNP context sequences disclosed in Table 1, and SEQ ID NOS: 24-89 correspond to genomic-based context sequences disclosed in Table 2), the alternative nucleotides (alleles) at each SNP position, and additional information about the variant where relevant, such as SNP type (coding, missense, splice site, UTR, etc.), human populations in which the SNP was observed, observed allele frequencies, information about the encoded protein, etc.

Isolated Nucleic Acid Molecules

The present invention provides isolated nucleic acid molecules that contain one or more SNPs disclosed Table 1 and/or Table 2. Preferred isolated nucleic acid molecules contain one or more SNPs identified as Applera or Celera proprietary. Isolated nucleic acid molecules containing one or more SNPs disclosed in at least one of Tables 1-2 may be interchangeably referred to throughout the present text as "SNP-containing nucleic acid molecules". Isolated nucleic acid molecules may optionally encode a full-length variant protein or fragment thereof. The isolated nucleic acid molecules of the present invention also include probes and primers (which are described in greater detail below in the section entitled "SNP Detection Reagents"), which may be used for assaying the disclosed SNPs, and isolated full-length genes, transcripts, cDNA molecules, and fragments thereof, which may be used for such purposes as expressing an encoded protein.

As used herein, an "isolated nucleic acid molecule" generally is one that contains a SNP of the present invention or one that hybridizes to such molecule such as a nucleic acid with a complementary sequence, and is separated from most other nucleic acids present in the natural source of the nucleic acid molecule. Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. A nucleic acid molecule can be fused to other coding or regulatory sequences and still be considered "isolated". Nucleic acid molecules present in non-human transgenic animals, which do not naturally occur in the animal, are also considered "isolated". For example, recombinant DNA molecules contained in a vector are considered "isolated". Further examples of "isolated" DNA molecules include recombinant DNA molecules maintained in heterologous host cells, and purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Generally, an isolated SNP-containing nucleic acid molecule comprises one or more SNP positions disclosed by the present invention with flanking nucleotide sequences on either side of the SNP positions. A flanking sequence can include nucleotide residues that are naturally associated with the SNP site and/or heterologous nucleotide sequences. Preferably the flanking sequence is up to about 500, 300, 100, 60, 50, 30, 25, 20, 15, 10, 8, or 4 nucleotides (or any other length in-between) on either side of a SNP position, or as long as the full-length gene or entire protein-coding sequence (or any portion thereof such as an exon), especially if the SNP-containing nucleic acid molecule is to be used to produce a protein or protein fragment.

For full-length genes and entire protein-coding sequences, a SNP flanking sequence can be, for example, up to about 5 KB, 4 KB, 3 KB, 2 KB, 1 KB on either side of the SNP. Furthermore, in such instances, the isolated nucleic acid molecule comprises exonic sequences (including protein-coding and/or non-coding exonic sequences), but may also include intronic sequences. Thus, any protein coding sequence may be either contiguous or separated by introns. The important point is that the nucleic acid is isolated from remote and unimportant flanking sequences and is of appropriate length such that it can be subjected to the specific manipulations or uses described herein such as recombinant protein expression, preparation of probes and primers for assaying the SNP position, and other uses specific to the SNP-containing nucleic acid sequences.

An isolated SNP-containing nucleic acid molecule can comprise, for example, a full-length gene or transcript, such as a gene isolated from genomic DNA (e.g., by cloning or PCR amplification), a cDNA molecule, or an mRNA transcript molecule. Polymorphic transcript sequences are provided in Table 1 and in the Sequence Listing (SEQ ID NOS: 1-3), and polymorphic genomic sequences are provided in Table 2 and in the Sequence Listing (SEQ ID NOS:13-23). Furthermore, fragments of such full-length genes and transcripts that contain one or more SNPs disclosed herein are also encompassed by the present invention, and such fragments may be used, for example, to express any part of a protein, such as a particular functional domain or an antigenic epitope.

Thus, the present invention also encompasses fragments of the nucleic acid sequences provided in Tables 1-2 (transcript sequences are provided in Table 1 as SEQ ID NOS:1-3, genomic sequences are provided in Table 2 as SEQ ID NOS: 13-23, transcript-based SNP context sequences are provided in Table 1 as SEQ ID NO:7-12, and genomic-based SNP context sequences are provided in Table 2 as SEQ ID NO:24-89) and their complements. A fragment typically comprises a contiguous nucleotide sequence at least about 8 or more nucleotides, more preferably at least about 12 or more nucleotides, and even more preferably at least about 16 or more nucleotides. Further, a fragment could comprise at least about 18, 20, 22, 25, 30, 40, 50, 60, 80, 100, 150, 200, 250 or 500 (or any other number in-between) nucleotides in length. The length of the fragment will be based on its intended use. For example, the fragment can encode epitope-bearing regions of a variant peptide or regions of a variant peptide that differ from the normal/wild-type protein, or can be useful as a polynucleotide probe or primer. Such fragments can be isolated using the nucleotide sequences provided in Table 1 and/or Table 2 for the synthesis of a polynucleotide probe. A labeled probe can then be used, for example, to screen a cDNA library, genomic DNA library, or mRNA to isolate nucleic acid corresponding to the coding region. Further, primers can be used in amplification reactions, such as for purposes of assaying one or more SNPs sites or for cloning specific regions of a gene.

An isolated nucleic acid molecule of the present invention further encompasses a SNP-containing polynucleotide that is the product of any one of a variety of nucleic acid amplification methods, which are used to increase the copy numbers of a polynucleotide of interest in a nucleic acid sample. Such amplification methods are well known in the art, and they include but are not limited to, polymerase chain reaction (PCR) (U.S. Pat. Nos. 4,683,195; and 4,683,202; *PCR Technology: Principles and Applications for DNA Amplification*, ed. H. A. Erlich, Freeman Press, NY, N.Y., 1992), ligase chain reaction (LCR) (Wu and Wallace, *Genomics* 4:560, 1989; Landegren et al., *Science* 241:1077, 1988), strand displacement amplification (SDA) (U.S. Pat. Nos. 5,270,184; and 5,422,252), transcription-mediated amplification (TMA) (U.S. Pat. No. 5,399,491), linked linear amplification (LLA) (U.S. Pat. No. 6,027,923), and the like, and isothermal amplification methods such as nucleic acid sequence based amplification (NASBA), and self-sustained sequence replication (Guatelli et al., *Proc. Natl. Acad. Sci. USA* 87: 1874, 1990). Based on such methodologies, a person skilled in the art can readily design primers in any suitable regions 5' and 3' to a SNP disclosed herein. Such primers may be used to amplify DNA of any length so long that it contains the SNP of interest in its sequence.

As used herein, an "amplified polynucleotide" of the invention is a SNP-containing nucleic acid molecule whose amount has been increased at least two fold by any nucleic acid amplification method performed in vitro as compared to its starting amount in a test sample. In other preferred embodiments, an amplified polynucleotide is the result of at least ten fold, fifty fold, one hundred fold, one thousand fold, or even ten thousand fold increase as compared to its starting amount in a test sample. In a typical PCR amplification, a polynucleotide of interest is often amplified at least fifty thousand fold in amount over the unamplified genomic DNA, but the precise amount of amplification needed for an assay depends on the sensitivity of the subsequent detection method used.

Generally, an amplified polynucleotide is at least about 16 nucleotides in length. More typically, an amplified polynucleotide is at least about 20 nucleotides in length. In a preferred embodiment of the invention, an amplified polynucleotide is at least about 30 nucleotides in length. In a more preferred embodiment of the invention, an amplified polynucleotide is at least about 32, 40, 45, 50, or 60 nucleotides in length. In yet another preferred embodiment of the invention, an amplified polynucleotide is at least about 100, 200, 300, 400, or 500 nucleotides in length. While the total length of an amplified polynucleotide of the invention can be as long as an exon, an intron or the entire gene where the SNP of interest resides, an amplified product is typically up to about 1,000 nucleotides in length (although certain amplification methods may generate amplified products greater than 1000 nucleotides in length). More preferably, an amplified polynucleotide is not greater than about 600-700 nucleotides in length. It is understood that irrespective of the length of an amplified polynucleotide, a SNP of interest may be located anywhere along its sequence.

In a specific embodiment of the invention, the amplified product is at least about 201 nucleotides in length, comprises one of the transcript-based context sequences or the genomic-based context sequences shown in Tables 1-2. Such a product may have additional sequences on its 5' end or 3' end or both. In another embodiment, the amplified product is about 101 nucleotides in length, and it contains a SNP disclosed herein.

Preferably, the SNP is located at the middle of the amplified product (e.g., at position 101 in an amplified product that is 201 nucleotides in length, or at position 51 in an amplified product that is 101 nucleotides in length), or within 1, 2, 3, 4, 5, 6, 7, 8, 9, 10, 12, 15, or 20 nucleotides from the middle of the amplified product (however, as indicated above, the SNP of interest may be located anywhere along the length of the amplified product).

The present invention provides isolated nucleic acid molecules that comprise, consist of, or consist essentially of one or more polynucleotide sequences that contain one or more SNPs disclosed herein, complements thereof, and SNP-containing fragments thereof.

Accordingly, the present invention provides nucleic acid molecules that consist of any of the nucleotide sequences shown in Table 1 and/or Table 2 (transcript sequences are provided in Table 1 as SEQ ID NOS:1-3, genomic sequences are provided in Table 2 as SEQ ID NOS:13-23, transcript-based SNP context sequences are provided in Table 1 as SEQ ID NO:7-12, and genomic-based SNP context sequences are provided in Table 2 as SEQ ID NO:24-89), or any nucleic acid molecule that encodes any of the variant proteins provided in Table 1 (SEQ ID NOS:4-6). A nucleic acid molecule consists of a nucleotide sequence when the nucleotide sequence is the complete nucleotide sequence of the nucleic acid molecule.

The present invention further provides nucleic acid molecules that consist essentially of any of the nucleotide sequences shown in Table 1 and/or Table 2 (transcript sequences are provided in Table 1 as SEQ ID NOS:1-3, genomic sequences are provided in Table 2 as SEQ ID NOS:13-23, transcript-based SNP context sequences are provided in Table 1 as SEQ ID NO:7-12, and genomic-based SNP context sequences are provided in Table 2 as SEQ ID NO:24-89), or any nucleic acid molecule that encodes any of the variant proteins provided in Table 1 (SEQ ID NOS:4-6). A nucleic acid molecule consists essentially of a nucleotide sequence when such a nucleotide sequence is present with only a few additional nucleotide residues in the final nucleic acid molecule.

The present invention further provides nucleic acid molecules that comprise any of the nucleotide sequences shown in Table 1 and/or Table 2 or a SNP-containing fragment thereof (transcript sequences are provided in Table 1 as SEQ ID NOS:1-3, genomic sequences are provided in Table 2 as SEQ ID NOS:13-23, transcript-based SNP context sequences are provided in Table 1 as SEQ ID NO:7-12, and genomic-based SNP context sequences are provided in Table 2 as SEQ ID NO:24-89), or any nucleic acid molecule that encodes any of the variant proteins provided in Table 1 (SEQ ID NOS:4-6). A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleotide residues, such as residues that are naturally associated with it or heterologous nucleotide sequences. Such a nucleic acid molecule can have one to a few additional nucleotides or can comprise many more additional nucleotides. A brief description of how various types of these nucleic acid molecules can be readily made and isolated is provided below, and such techniques are well known to those of ordinary skill in the art (Sambrook and Russell, 2000, Molecular Cloning: A Laboratory Manual, Cold Spring Harbor Press, NY).

The isolated nucleic acid molecules can encode mature proteins plus additional amino or carboxyl-terminal amino acids or both, or amino acids interior to the mature peptide (when the mature form has more than one peptide chain, for instance). Such sequences may play a role in processing of a protein from precursor to a mature form, facilitate protein trafficking, prolong or shorten protein half-life, or facilitate manipulation of a protein for assay or production. As generally is the case in situ, the additional amino acids may be processed away from the mature protein by cellular enzymes.

Thus, the isolated nucleic acid molecules include, but are not limited to, nucleic acid molecules having a sequence encoding a peptide alone, a sequence encoding a mature peptide and additional coding sequences such as a leader or secretory sequence (e.g., a pre-pro or pro-protein sequence), a sequence encoding a mature peptide with or without additional coding sequences, plus additional non-coding sequences, for example introns and non-coding 5' and 3' sequences such as transcribed but untranslated sequences that play a role in, for example, transcription, mRNA processing (including splicing and polyadenylation signals), ribosome binding, and/or stability of mRNA. In addition, the nucleic acid molecules may be fused to heterologous marker sequences encoding, for example, a peptide that facilitates purification.

Isolated nucleic acid molecules can be in the form of RNA, such as mRNA, or in the form DNA, including cDNA and genomic DNA, which may be obtained, for example, by molecular cloning or produced by chemical synthetic techniques or by a combination thereof (Sambrook and Russell, 2000, Molecular Cloning: A Laboratory Manual, Cold Spring Harbor Press, NY). Furthermore, isolated nucleic acid molecules, particularly SNP detection reagents such as probes and primers, can also be partially or completely in the form of one or more types of nucleic acid analogs, such as peptide nucleic acid (PNA) (U.S. Pat. Nos. 5,539,082; 5,527,675; 5,623,049; 5,714,331). The nucleic acid, especially DNA, can be double-stranded or single-stranded. Single-stranded nucleic acid can be the coding strand (sense strand) or the complementary non-coding strand (anti-sense strand). DNA, RNA, or PNA segments can be assembled, for example, from fragments of the human genome (in the case of DNA or RNA) or single nucleotides, short oligonucleotide linkers, or from a series of oligonucleotides, to provide a synthetic nucleic acid molecule. Nucleic acid molecules can be readily synthesized using the sequences provided herein as a reference; oligonucleotide and PNA oligomer synthesis techniques are well known in the art (see, e.g., Corey, "Peptide nucleic acids: expanding the scope of nucleic acid recognition", *Trends Biotechnol.* 1997 June; 15(6):224-9, and Hyrup et al., "Peptide nucleic acids (PNA): synthesis, properties and potential applications", *Bioorg Med Chem.* 1996 January; 4(1):5-23). Furthermore, large-scale automated oligonucleotide/PNA synthesis (including synthesis on an array or bead surface or other solid support) can readily be accomplished using commercially available nucleic acid synthesizers, such as the Applied Biosystems (Foster City, Calif.) 3900 High-Throughput DNA Synthesizer or Expedite 8909 Nucleic Acid Synthesis System, and the sequence information provided herein.

The present invention encompasses nucleic acid analogs that contain modified, synthetic, or non-naturally occurring nucleotides or structural elements or other alternative/modified nucleic acid chemistries known in the art. Such nucleic acid analogs are useful, for example, as detection reagents (e.g., primers/probes) for detecting one or more SNPs identified in Table 1 and/or Table 2. Furthermore, kits/systems (such as beads, arrays, etc.) that include these analogs are also encompassed by the present invention. For example, PNA oligomers that are based on the polymorphic sequences of the present invention are specifically contemplated. PNA oligomers are analogs of DNA in which the phosphate backbone is replaced with a peptide-like backbone (Lagriffoul et al., Bioorganic & Medicinal Chemistry Letters, 4: 1081-1082 (1994), Petersen et al., Bioorganic & Medicinal Chemistry Letters, 6: 793-796 (1996), Kumar et al., Organic Letters 3(9): 1269-1272 (2001), WO96/04000). PNA hybridizes to complementary RNA or DNA with higher affinity and specificity than conventional oligonucleotides and oligonucleotide analogs. The properties of PNA enable novel molecular biology and biochemistry applications unachievable with traditional oligonucleotides and peptides.

Additional examples of nucleic acid modifications that improve the binding properties and/or stability of a nucleic acid include the use of base analogs such as inosine, intercalators (U.S. Pat. No. 4,835,263) and the minor groove binders (U.S. Pat. No. 5,801,115). Thus, references herein to nucleic acid molecules, SNP-containing nucleic acid molecules, SNP detection reagents (e.g., probes and primers), oligonucleotides/polynucleotides include PNA oligomers and other nucleic acid analogs. Other examples of nucleic acid analogs and alternative/modified nucleic acid chemistries known in the art are described in *Current Protocols in Nucleic Acid Chemistry*, John Wiley & Sons, N.Y. (2002).

The present invention further provides nucleic acid molecules that encode fragments of the variant polypeptides disclosed herein as well as nucleic acid molecules that encode obvious variants of such variant polypeptides. Such nucleic acid molecules may be naturally occurring, such as paralogs (different locus) and orthologs (different organism), or may be constructed by recombinant DNA methods or by chemical synthesis. Non-naturally occurring variants may be made by mutagenesis techniques, including those applied to nucleic acid molecules, cells, or organisms. Accordingly, the variants can contain nucleotide substitutions, deletions, inversions and insertions (in addition to the SNPs disclosed in Tables 1-2). Variation can occur in either or both the coding and non-coding regions. The variations can produce conservative and/or non-conservative amino acid substitutions.

Further variants of the nucleic acid molecules disclosed in Tables 1-2, such as naturally occurring allelic variants (as well as orthologs and paralogs) and synthetic variants produced by mutagenesis techniques, can be identified and/or produced using methods well known in the art. Such further variants can comprise a nucleotide sequence that shares at least 70-80%, 80-85%, 85-90%, 91%, 92%, 93%, 94%, 95%, 96%, 97%, 98%, or 99% sequence identity with a nucleic acid sequence disclosed in Table 1 and/or Table 2 (or a fragment thereof) and that includes a novel SNP allele disclosed in Table 1 and/or Table 2. Further, variants can comprise a nucleotide sequence that encodes a polypeptide that shares at least 70-80%, 80-85%, 85-90%, 91%, 92%, 93%, 94%, 95%, 96%, 97%, 98%, or 99% sequence identity with a polypeptide sequence disclosed in Table 1 (or a fragment thereof) and that includes a novel SNP allele disclosed in Table 1 and/or Table 2. Thus, an aspect of the present invention that is specifically contemplated are isolated nucleic acid molecules that have a certain degree of sequence variation compared with the sequences shown in Tables 1-2, but that contain a novel SNP allele disclosed herein. In other words, as long as an isolated nucleic acid molecule contains a novel SNP allele disclosed herein, other portions of the nucleic acid molecule that flank the novel SNP allele can vary to some degree from the specific transcript, genomic, and context sequences shown in Tables 1-2, and can encode a polypeptide that varies to some degree from the specific polypeptide sequences shown in Table 1.

To determine the percent identity of two amino acid sequences or two nucleotide sequences of two molecules that share sequence homology, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. (*Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part 1, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991). In a preferred embodiment, the percent identity between two amino acid sequences is determined using the Needleman and Wunsch algorithm (*J. Mol. Biol.* (48):444-453 (1970)) which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6.

In yet another preferred embodiment, the percent identity between two nucleotide sequences is determined using the GAP program in the GCG software package (Devereux, J., et al., *Nucleic Acids Res.* 12(1):387 (1984)), using a NWSgapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4:11-17 (1989)) which has been incorporated into the ALIGN program (version 2.0), using a PAM120 weight residue table, a gap length penalty of 12, and a gap penalty of 4.

The nucleotide and amino acid sequences of the present invention can further be used as a "query sequence" to perform a search against sequence databases to, for example, identify other family members or related sequences. Such searches can be performed using the NBLAST and XBLAST programs (version 2.0) of Altschul, et al. (*J. Mol. Biol.* 215: 403-10 (1990)). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized as described in Altschul et al. (*Nucleic Acids Res.* 25(17):3389-3402 (1997)). When utilizing BLAST and gapped BLAST programs, the default parameters of the respective programs (e.g., XBLAST and NBLAST) can be used. In addition to BLAST, examples of other search and sequence comparison programs used in the art include, but are not limited to, FASTA (Pearson, *Methods Mol. Biol.* 25, 365-389 (1994)) and KERR (Dufresne et al., *Nat Biotechnol* 2002 December; 20(12):1269-71). For further information regarding bioinformatics techniques, see *Current Protocols in Bioinformatics*, John Wiley & Sons, Inc., N.Y.

The present invention further provides non-coding fragments of the nucleic acid molecules disclosed in Table 1 and/or Table 2. Preferred non-coding fragments include, but are not limited to, promoter sequences, enhancer sequences, intronic sequences, 5' untranslated regions (UTRs), 3' untranslated regions, gene modulating sequences and gene termination sequences. Such fragments are useful, for example, in controlling heterologous gene expression and in developing screens to identify gene-modulating agents.

SNP Detection Reagents

In a specific aspect of the present invention, the SNPs disclosed in Table 1 and/or Table 2, and their associated transcript sequences (provided in Table 1 as SEQ ID NOS:1-3), genomic sequences (provided in Table 2 as SEQ ID NOS:13-23), and context sequences (transcript-based context sequences are provided in Table 1 as SEQ ID NOS:7-12; genomic-based context sequences are provided in Table 2 as SEQ ID NOS:24-89), can be used for the design of SNP detection reagents. As used herein, a "SNP detection reagent" is a reagent that specifically detects a specific target SNP position disclosed herein, and that is preferably specific for a particular nucleotide (allele) of the target SNP position (i.e., the detection reagent preferably can differentiate between different alternative nucleotides at a target SNP position, thereby allowing the identity of the nucleotide present at the target SNP position to be determined). Typically, such detection reagent hybridizes to a target SNP-containing nucleic acid molecule by complementary base-pairing in a sequence specific manner, and discriminates the target variant sequence from other nucleic acid sequences such as an art-known form in a test sample. An example of a detection reagent is a probe that hybridizes to a target nucleic acid containing one or more of the SNPs provided in Table 1 and/or Table 2. In a preferred embodiment, such a probe can differentiate between nucleic acids having a particular nucleotide (allele) at a target SNP position from other nucleic acids that have a different nucleotide at the same target SNP position. In addition, a detection reagent may hybridize to a specific region 5' and/or 3' to a SNP position, particularly a region corresponding to the context sequences provided in Table 1 and/or Table 2 (transcript-based context sequences are provided in Table 1 as SEQ ID NOS:7-12; genomic-based context sequences are provided in Table 2 as SEQ ID NOS:24-89). Another example of a detection reagent is a primer which acts as an initiation point of nucleotide extension along a complementary strand of a target polynucleotide. The SNP sequence information provided herein is also useful for designing primers, e.g. allele-specific primers, to amplify (e.g., using PCR) any SNP of the present invention.

In one preferred embodiment of the invention, a SNP detection reagent is an isolated or synthetic DNA or RNA polynucleotide probe or primer or PNA oligomer, or a combination of DNA, RNA and/or PNA, that hybridizes to a segment of a target nucleic acid molecule containing a SNP identified in Table 1 and/or Table 2. A detection reagent in the form of a polynucleotide may optionally contain modified base analogs, intercalators or minor groove binders. Multiple detection reagents such as probes may be, for example, affixed to a solid support (e.g., arrays or beads) or supplied in solution (e.g., probe/primer sets for enzymatic reactions such as PCR, RT-PCR, TaqMan assays, or primer-extension reactions) to form a SNP detection kit.

A probe or primer typically is a substantially purified oligonucleotide or PNA oligomer. Such oligonucleotide typically comprises a region of complementary nucleotide sequence that hybridizes under stringent conditions to at least about 8, 10, 12, 16, 18, 20, 22, 25, 30, 40, 50, 55, 60, 65, 70, 80, 90, 100, 120 (or any other number in-between) or more consecutive nucleotides in a target nucleic acid molecule. Depending on the particular assay, the consecutive nucleotides can either include the target SNP position, or be a specific region in close enough proximity 5' and/or 3' to the SNP position to carry out the desired assay.

Other preferred primer and probe sequences can readily be determined using the transcript sequences (SEQ ID NOS:1-3), genomic sequences (SEQ ID NOS:13-23), and SNP context sequences (transcript-based context sequences are provided in Table 1 as SEQ ID NOS:7-12; genomic-based context sequences are provided in Table 2 as SEQ ID NOS:24-89) disclosed in the Sequence Listing and in Tables 1-2. It will be apparent to one of skill in the art that such primers and probes are directly useful as reagents for genotyping the SNPs of the present invention, and can be incorporated into any kit/system format.

In order to produce a probe or primer specific for a target SNP-containing sequence, the gene/transcript and/or context sequence surrounding the SNP of interest is typically examined using a computer algorithm which starts at the 5' or at the 3' end of the nucleotide sequence. Typical algorithms will then identify oligomers of defined length that are unique to the gene/SNP context sequence, have a GC content within a range suitable for hybridization, lack predicted secondary structure that may interfere with hybridization, and/or possess other desired characteristics or that lack other undesired characteristics.

A primer or probe of the present invention is typically at least about 8 nucleotides in length. In one embodiment of the invention, a primer or a probe is at least about 10 nucleotides in length. In a preferred embodiment, a primer or a probe is at least about 12 nucleotides in length. In a more preferred embodiment, a primer or probe is at least about 16, 17, 18, 19, 20, 21, 22, 23, 24 or 25 nucleotides in length. While the maximal length of a probe can be as long as the target sequence to be detected, depending on the type of assay in which it is employed, it is typically less than about 50, 60, 65, or 70 nucleotides in length. In the case of a primer, it is typically less than about 30 nucleotides in length. In a specific preferred embodiment of the invention, a primer or a probe is within the length of about 18 and about 28 nucleotides. However, in other embodiments, such as nucleic acid arrays and other embodiments in which probes are affixed to a substrate, the probes can be longer, such as on the order of 30-70, 75, 80, 90, 100, or more nucleotides in length (see the section below entitled "SNP Detection Kits and Systems").

For analyzing SNPs, it may be appropriate to use oligonucleotides specific for alternative SNP alleles. Such oligonucleotides which detect single nucleotide variations in target sequences may be referred to by such terms as "allele-specific oligonucleotides", "allele-specific probes", or "allele-specific primers". The design and use of allele-specific probes for analyzing polymorphisms is described in, e.g., *Mutation Detection A Practical Approach*, ed. Cotton et al. Oxford University Press, 1998; Saiki et al., *Nature* 324, 163-166 (1986); Dattagupta, EP235,726; and Saiki, WO 89/11548.

While the design of each allele-specific primer or probe depends on variables such as the precise composition of the nucleotide sequences flanking a SNP position in a target nucleic acid molecule, and the length of the primer or probe, another factor in the use of primers and probes is the stringency of the condition under which the hybridization between the probe or primer and the target sequence is performed. Higher stringency conditions utilize buffers with lower ionic strength and/or a higher reaction temperature, and tend to require a more perfect match between probe/primer and a target sequence in order to form a stable duplex. If the stringency is too high, however, hybridization may not occur at all. In contrast, lower stringency conditions utilize buffers with higher ionic strength and/or a lower reaction temperature, and permit the formation of stable duplexes with more mismatched bases between a probe/primer and a target sequence. By way of example and not limitation, exemplary conditions for high stringency hybridization conditions using an allele-specific probe are as follows: Prehybridization with a solution containing 5× standard saline phosphate EDTA (SSPE), 0.5% $NaDodSO_4$ (SDS) at 55° C., and incubating probe with target nucleic acid molecules in the same solution at the same temperature, followed by washing with a solution containing 2×SSPE, and 0.1% SDS at 55° C. or room temperature.

Moderate stringency hybridization conditions may be used for allele-specific primer extension reactions with a solution containing, e.g., about 50 mM KCl at about 46° C. Alternatively, the reaction may be carried out at an elevated temperature such as 60° C. In another embodiment, a moderately stringent hybridization condition suitable for oligonucleotide ligation assay (OLA) reactions wherein two probes are ligated if they are completely complementary to the target sequence may utilize a solution of about 100 mM KCl at a temperature of 46° C.

In a hybridization-based assay, allele-specific probes can be designed that hybridize to a segment of target DNA from one individual but do not hybridize to the corresponding segment from another individual due to the presence of different polymorphic forms (e.g., alternative SNP alleles/nucleotides) in the respective DNA segments from the two individuals. Hybridization conditions should be sufficiently stringent that there is a significant detectable difference in hybridization intensity between alleles, and preferably an essentially binary response, whereby a probe hybridizes to only one of the alleles or significantly more strongly to one allele. While a probe may be designed to hybridize to a target sequence that contains a SNP site such that the SNP site aligns anywhere along the sequence of the probe, the probe is preferably designed to hybridize to a segment of the target sequence such that the SNP site aligns with a central position of the probe (e.g., a position within the probe that is at least three nucleotides from either end of the probe). This design of probe generally achieves good discrimination in hybridization between different allelic forms.

In another embodiment, a probe or primer may be designed to hybridize to a segment of target DNA such that the SNP aligns with either the 5' most end or the 3' most end of the probe or primer. In a specific preferred embodiment which is particularly suitable for use in a oligonucleotide ligation assay (U.S. Pat. No. 4,988,617), the 3' most nucleotide of the probe aligns with the SNP position in the target sequence.

Oligonucleotide probes and primers may be prepared by methods well known in the art. Chemical synthetic methods include, but are not limited to, the phosphotriester method described by Narang et al., 1979, Methods in Enzymology 68:90; the phosphodiester method described by Brown et al., 1979, Methods in Enzymology 68:109, the diethylphosphoamidate method described by Beaucage et al., 1981, *Tetrahedron Letters* 22:1859; and the solid support method described in U.S. Pat. No. 4,458,066.

Allele-specific probes are often used in pairs (or, less commonly, in sets of 3 or 4, such as if a SNP position is known to have 3 or 4 alleles, respectively, or to assay both strands of a nucleic acid molecule for a target SNP allele), and such pairs may be identical except for a one nucleotide mismatch that represents the allelic variants at the SNP position. Commonly, one member of a pair perfectly matches a reference form of a target sequence that has a more common SNP allele (i.e., the allele that is more frequent in the target population) and the other member of the pair perfectly matches a form of the target sequence that has a less common SNP allele (i.e., the allele that is rarer in the target population). In the case of an array, multiple pairs of probes can be immobilized on the same support for simultaneous analysis of multiple different polymorphisms.

In one type of PCR-based assay, an allele-specific primer hybridizes to a region on a target nucleic acid molecule that overlaps a SNP position and only primes amplification of an allelic form to which the primer exhibits perfect complementarity (Gibbs, 1989, *Nucleic Acid Res.* 17 2427-2448). Typically, the primer's 3'-most nucleotide is aligned with and complementary to the SNP position of the target nucleic acid molecule. This primer is used in conjunction with a second primer that hybridizes at a distal site. Amplification proceeds from the two primers, producing a detectable product that indicates which allelic form is present in the test sample. A control is usually performed with a second pair of primers, one of which shows a single base mismatch at the polymorphic site and the other of which exhibits perfect complementarity to a distal site. The single-base mismatch prevents amplification or substantially reduces amplification efficiency, so that either no detectable product is formed or it is formed in lower amounts or at a slower pace. The method generally works most effectively when the mismatch is at the 3'-most position of the oligonucleotide (i.e., the 3'-most position of the oligonucleotide aligns with the target SNP position) because this position is most destabilizing to elongation from the primer (see, e.g., WO 93/22456). This PCR-based assay can be utilized as part of the TaqMan assay, described below.

In a specific embodiment of the invention, a primer of the invention contains a sequence substantially complementary to a segment of a target SNP-containing nucleic acid molecule except that the primer has a mismatched nucleotide in one of the three nucleotide positions at the 3'-most end of the primer, such that the mismatched nucleotide does not base pair with a particular allele at the SNP site. In a preferred embodiment, the mismatched nucleotide in the primer is the second from the last nucleotide at the 3'-most position of the primer. In a more preferred embodiment, the mismatched nucleotide in the primer is the last nucleotide at the 3'-most position of the primer.

In another embodiment of the invention, a SNP detection reagent of the invention is labeled with a fluorogenic reporter dye that emits a detectable signal. While the preferred reporter dye is a fluorescent dye, any reporter dye that can be attached to a detection reagent such as an oligonucleotide probe or primer is suitable for use in the invention. Such dyes include, but are not limited to, Acridine, AMCA, BODIPY, Cascade Blue, Cy2, Cy3, Cy5, Cy7, Dabcyl, Edans, Eosin, Erythrosin, Fluorescein, 6-Fam, Tet, Joe, Hex, Oregon Green, Rhodamine, Rhodol Green, Tamra, Rox, and Texas Red.

In yet another embodiment of the invention, the detection reagent may be further labeled with a quencher dye such as Tamra, especially when the reagent is used as a self-quenching probe such as a TaqMan (U.S. Pat. Nos. 5,210,015 and 5,538,848) or Molecular Beacon probe (U.S. Pat. Nos. 5,118,801 and 5,312,728), or other stemless or linear beacon probe (Livak et al., 1995, PCR Method Appl. 4:357-362; Tyagi et al., 1996, Nature Biotechnology 14: 303-308; Nazarenko et al., 1997, Nucl. Acids Res. 25:2516-2521; U.S. Pat. Nos. 5,866,336 and 6,117,635).

The detection reagents of the invention may also contain other labels, including but not limited to, biotin for streptavidin binding, hapten for antibody binding, and oligonucleotide for binding to another complementary oligonucleotide such as pairs of zipcodes.

The present invention also contemplates reagents that do not contain (or that are complementary to) a SNP nucleotide identified herein but that are used to assay one or more SNPs disclosed herein. For example, primers that flank, but do not hybridize directly to a target SNP position provided herein are useful in primer extension reactions in which the primers hybridize to a region adjacent to the target SNP position (i.e., within one or more nucleotides from the target SNP site). During the primer extension reaction, a primer is typically not able to extend past a target SNP site if a particular nucleotide (allele) is present at that target SNP site, and the primer extension product can be detected in order to determine which SNP allele is present at the target SNP site. For example, particular ddNTPs are typically used in the primer extension reaction to terminate primer extension once a ddNTP is incorporated into the extension product (a primer extension product which includes a ddNTP at the 3'-most end of the primer extension product, and in which the ddNTP is a nucleotide of a SNP disclosed herein, is a composition that is specifically contemplated by the present invention). Thus, reagents that bind to a nucleic acid molecule in a region adjacent to a SNP site and that are used for assaying the SNP site, even though the bound sequences do not necessarily include the SNP site itself, are also contemplated by the present invention.

SNP Detection Kits and Systems

A person skilled in the art will recognize that, based on the SNP and associated sequence information disclosed herein, detection reagents can be developed and used to assay any SNP of the present invention individually or in combination, and such detection reagents can be readily incorporated into one of the established kit or system formats which are well known in the art. The terms "kits" and "systems", as used herein in the context of SNP detection reagents, are intended to refer to such things as combinations of multiple SNP detection reagents, or one or more SNP detection reagents in combination with one or more other types of elements or components (e.g., other types of biochemical reagents, containers, packages such as packaging intended for commercial sale, substrates to which SNP detection reagents are attached, electronic hardware components, etc.). Accordingly, the present invention further provides SNP detection kits and systems, including but not limited to, packaged probe and primer sets (e.g., TaqMan probe/primer sets), arrays/microarrays of nucleic acid molecules, and beads that contain one or more probes, primers, or other detection reagents for detecting one or more SNPs of the present invention. The kits/systems can optionally include various electronic hardware components; for example, arrays ("DNA chips") and microfluidic systems ("lab-on-a-chip" systems) provided by various manufacturers typically comprise hardware components. Other kits/systems (e.g., probe/primer sets) may not include electronic hardware components, but may be comprised of, for example, one or more SNP detection reagents (along with, optionally, other biochemical reagents) packaged in one or more containers.

In some embodiments, a SNP detection kit typically contains one or more detection reagents and other components (e.g., a buffer, enzymes such as DNA polymerases or ligases, chain extension nucleotides such as deoxynucleotide triphosphates, and in the case of Sanger-type DNA sequencing reactions, chain terminating nucleotides, positive control sequences, negative control sequences, and the like) necessary to carry out an assay or reaction, such as amplification and/or detection of a SNP-containing nucleic acid molecule. A kit may further contain means for determining the amount of a target nucleic acid, and means for comparing the amount with a standard, and can comprise instructions for using the kit to detect the SNP-containing nucleic acid molecule of interest. In one embodiment of the present invention, kits are provided which contain the necessary reagents to carry out one or more assays to detect one or more SNPs disclosed herein. In a preferred embodiment of the present invention, SNP detection kits/systems are in the form of nucleic acid arrays, or compartmentalized kits, including microfluidic/lab-on-a-chip systems.

SNP detection kits/systems may contain, for example, one or more probes, or pairs of probes, that hybridize to a nucleic acid molecule at or near each target SNP position. Multiple pairs of allele-specific probes may be included in the kit/system to simultaneously assay large numbers of SNPs, at least one of which is a SNP of the present invention. In some kits/systems, the allele-specific probes are immobilized to a substrate such as an array or bead. For example, the same substrate can comprise allele-specific probes for detecting at least 1; 10; 100; 1000; 10,000; 100,000 (or any other number in-between) or substantially all of the SNPs shown in Table 1 and/or Table 2.

The terms "arrays", "microarrays", and "DNA chips" are used herein interchangeably to refer to an array of distinct polynucleotides affixed to a substrate, such as glass, plastic, paper, nylon or other type of membrane, filter, chip, or any other suitable solid support. The polynucleotides can be synthesized directly on the substrate, or synthesized separate from the substrate and then affixed to the substrate. In one embodiment, the microarray is prepared and used according to the methods described in U.S. Pat. No. 5,837,832, Chee et al., PCT application WO95/11995 (Chee et al.), Lockhart, D. J. et al. (1996; Nat. Biotech. 14: 1675-1680) and Schena, M. et al. (1996; Proc. Natl. Acad. Sci. 93: 10614-10619), all of which are incorporated herein in their entirety by reference. In other embodiments, such arrays are produced by the methods described by Brown et al., U.S. Pat. No. 5,807,522.

Nucleic acid arrays are reviewed in the following references: Zammatteo et al., "New chips for molecular biology and diagnostics", Biotechnol Annu Rev. 2002; 8:85-101; Sosnowski et al., "Active microelectronic array system for DNA hybridization, genotyping and pharmacogenomic applications", Psychiatr Genet. 2002 December; 12 (4):181-92; Heller, "DNA microarray technology: devices, systems, and applications", Annu Rev Biomed Eng. 2002; 4: 129-53. Epub 2002 Mar. 22; Kolchinsky et al., "Analysis of SNPs and other genomic variations using gel-based chips", Hum Mutat. 2002 April; 19 (4):343-60; and McGall et al., "High-density genechip oligonucleotide probe arrays", Adv Biochem Eng Biotechnol. 2002; 77:21-42.

Any number of probes, such as allele-specific probes, may be implemented in an array, and each probe or pair of probes can hybridize to a different SNP position. In the case of polynucleotide probes, they can be synthesized at designated areas (or synthesized separately and then affixed to designated areas) on a substrate using a light-directed chemical process. Each DNA chip can contain, for example, thousands to millions of individual synthetic polynucleotide probes arranged in a grid-like pattern and miniaturized (e.g., to the size of a dime). Preferably, probes are attached to a solid support in an ordered, addressable array.

A microarray can be composed of a large number of unique, single-stranded polynucleotides, usually either synthetic antisense polynucleotides or fragments of cDNAs, fixed to a solid support. Typical polynucleotides are preferably about 6-60 nucleotides in length, more preferably about 15-30 nucleotides in length, and most preferably about 18-25 nucleotides in length. For certain types of microarrays or other detection kits/systems, it may be preferable to use oligonucleotides that are only about 7-20 nucleotides in length. In other types of arrays, such as arrays used in conjunction with chemiluminescent detection technology, preferred probe lengths can be, for example, about 15-80 nucleotides in length, preferably about 50-70 nucleotides in length, more preferably about 55-65 nucleotides in length, and most preferably about 60 nucleotides in length. The microarray or detection kit can contain polynucleotides that cover the known 5' or 3' sequence of a gene/transcript or target SNP site, sequential polynucleotides that cover the full-length sequence of a gene/transcript; or unique polynucleotides selected from particular areas along the length of a target gene/transcript sequence, particularly areas corresponding to one or more SNPs disclosed in Table 1 and/or Table 2. Polynucleotides used in the microarray or detection kit can be specific to a SNP or SNPs of interest (e.g., specific to a particular SNP allele at a target SNP site, or specific to particular SNP alleles at multiple different SNP sites), or specific to a polymorphic gene/transcript or genes/transcripts of interest.

Hybridization assays based on polynucleotide arrays rely on the differences in hybridization stability of the probes to perfectly matched and mismatched target sequence variants. For SNP genotyping, it is generally preferable that stringency conditions used in hybridization assays are high enough such that nucleic acid molecules that differ from one another at as little as a single SNP position can be differentiated (e.g., typical SNP hybridization assays are designed so that hybridization will occur only if one particular nucleotide is present at a SNP position, but will not occur if an alternative nucleotide is present at that SNP position). Such high stringency conditions may be preferable when using, for example, nucleic acid arrays of allele-specific probes for SNP detection. Such high stringency conditions are described in the preceding section, and are well known to those skilled in the art and can be found in, for example, *Current Protocols in Molecular Biology*, John Wiley & Sons, N.Y. (1989), 6.3.1-6.3.6.

In other embodiments, the arrays are used in conjunction with chemiluminescent detection technology. The following patents and patent applications, which are all hereby incorporated by reference, provide additional information pertaining to chemiluminescent detection: U.S. patent application Ser. Nos. 10/620,332 and 10/620,333 describe chemiluminescent approaches for microarray detection; U.S. Pat. Nos. 6,124,478, 6,107,024, 5,994,073, 5,981,768, 5,871,938, 5,843,681, 5,800,999, and 5,773,628 describe methods and compositions of dioxetane for performing chemiluminescent detection; and U.S. published application US2002/0110828 discloses methods and compositions for microarray controls.

In one embodiment of the invention, a nucleic acid array can comprise an array of probes of about 15-25 nucleotides in length. In further embodiments, a nucleic acid array can comprise any number of probes, in which at least one probe is capable of detecting one or more SNPs disclosed in Table 1 and/or Table 2, and/or at least one probe comprises a fragment of one of the sequences selected from the group consisting of those disclosed in Table 1, Table 2, the Sequence Listing, and sequences complementary thereto, said fragment comprising at least about 8 consecutive nucleotides, preferably 10, 12, 15, 16, 18, 20, more preferably 22, 25, 30, 40, 47, 50, 55, 60, 65, 70, 80, 90, 100, or more consecutive nucleotides (or any other number in-between) and containing (or being complementary to) a novel SNP allele disclosed in Table 1 and/or Table 2. In some embodiments, the nucleotide complementary to the SNP site is within 5, 4, 3, 2, or 1 nucleotide from the center of the probe, more preferably at the center of said probe.

A polynucleotide probe can be synthesized on the surface of the substrate by using a chemical coupling procedure and an ink jet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more polynucleotides, or any other number which lends itself to the efficient use of commercially available instrumentation.

Using such arrays or other kits/systems, the present invention provides methods of identifying the SNPs disclosed herein in a test sample. Such methods typically involve incubating a test sample of nucleic acids with an array comprising one or more probes corresponding to at least one SNP position of the present invention, and assaying for binding of a nucleic acid from the test sample with one or more of the probes. Conditions for incubating a SNP detection reagent (or a kit/system that employs one or more such SNP detection reagents) with a test sample vary. Incubation conditions depend on such factors as the format employed in the assay, the detection methods employed, and the type and nature of the detection reagents used in the assay. One skilled in the art will recognize that any one of the commonly available hybridization, amplification and array assay formats can readily be adapted to detect the SNPs disclosed herein.

A SNP detection kit/system of the present invention may include components that are used to prepare nucleic acids from a test sample for the subsequent amplification and/or detection of a SNP-containing nucleic acid molecule. Such sample preparation components can be used to produce nucleic acid extracts (including DNA and/or RNA), proteins or membrane extracts from any bodily fluids (such as blood, serum, plasma, urine, saliva, phlegm, gastric juices, semen, tears, sweat, etc.), skin, hair, cells (especially nucleated cells), biopsies, buccal swabs or tissue specimens. The test samples used in the above-described methods will vary based on such factors as the assay format, nature of the detection method, and the specific tissues, cells or extracts used as the test sample to be assayed. Methods of preparing nucleic acids, proteins, and cell extracts are well known in the art and can be readily adapted to obtain a sample that is compatible with the system utilized. Automated sample preparation systems for extracting nucleic acids from a test sample are commercially available, and examples are Qiagen's BioRobot 9600, Applied Biosystems' PRISM™ 6700 sample preparation system, and Roche Molecular Systems' COBAS AmpliPrep System.

Another form of kit contemplated by the present invention is a compartmentalized kit. A compartmentalized kit includes any kit in which reagents are contained in separate containers. Such containers include, for example, small glass containers, plastic containers, strips of plastic, glass or paper, or arraying material such as silica. Such containers allow one to efficiently transfer reagents from one compartment to another compartment such that the test samples and reagents are not cross-contaminated, or from one container to another vessel not included in the kit, and the agents or solutions of each container can be added in a quantitative fashion from one compartment to another or to another vessel. Such containers may include, for example, one or more containers which will accept the test sample, one or more containers which contain at least one probe or other SNP detection reagent for detecting one or more SNPs of the present invention, one or more containers which contain wash reagents (such as phosphate buffered saline, Tris-buffers, etc.), and one or more containers which contain the reagents used to reveal the presence of the bound probe or other SNP detection reagents. The kit can optionally further comprise compartments and/or reagents for, for example, nucleic acid amplification or other enzymatic reactions such as primer extension reactions, hybridization, ligation, electrophoresis (preferably capillary electrophoresis), mass spectrometry, and/or laser-induced fluorescent detection. The kit may also include instructions for using the kit. Exemplary compartmentalized kits include microfluidic devices known in the art (see, e.g., Weigl et al., "Lab-on-a-chip for drug development", *Adv Drug Deliv Rev.* 2003 Feb. 24; 55(3):349-77). In such microfluidic devices, the containers may be referred to as, for example, microfluidic "compartments", "chambers", or "channels".

Microfluidic devices, which may also be referred to as "lab-on-a-chip" systems, biomedical micro-electro-mechanical systems (bioMEMs), or multicomponent integrated systems, are exemplary kits/systems of the present invention for analyzing SNPs. Such systems miniaturize and compartmentalize processes such as probe/target hybridization, nucleic acid amplification, and capillary electrophoresis reactions in a single functional device. Such microfluidic devices typically utilize detection reagents in at least one aspect of the system, and such detection reagents may be used to detect one or more SNPs of the present invention. One example of a microfluidic system is disclosed in U.S. Pat. No. 5,589,136, which describes the integration of PCR amplification and capillary electrophoresis in chips. Exemplary microfluidic systems comprise a pattern of microchannels designed onto a glass, silicon, quartz, or plastic wafer included on a microchip. The movements of the samples may be controlled by electric, electroosmotic or hydrostatic forces applied across different areas of the microchip to create functional microscopic valves and pumps with no moving parts. Varying the voltage can be used as a means to control the liquid flow at intersections between the micro-machined channels and to change the liquid flow rate for pumping across different sections of the microchip. See, for example, U.S. Pat. Nos. 6,153,073, Dubrow et al., and 6,156,181, Parce et al.

For genotyping SNPs, an exemplary microfluidic system may integrate, for example, nucleic acid amplification, primer extension, capillary electrophoresis, and a detection method such as laser induced fluorescence detection. In a first step of an exemplary process for using such an exemplary system, nucleic acid samples are amplified, preferably by PCR. Then, the amplification products are subjected to automated primer extension reactions using ddNTPs (specific fluorescence for each ddNTP) and the appropriate oligonucleotide primers to carry out primer extension reactions which hybridize just upstream of the targeted SNP. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. Such an exemplary microchip can be used to process, for example, at least 96 to 384 samples, or more, in parallel.

Uses of Nucleic Acid Molecules

The nucleic acid molecules of the present invention have a variety of uses, especially in the diagnosis and treatment of psoriasis and related pathologies. For example, the nucleic acid molecules are useful as hybridization probes, such as for genotyping SNPs in messenger RNA, transcript, cDNA, genomic DNA, amplified DNA or other nucleic acid molecules, and for isolating full-length cDNA and genomic clones encoding the variant peptides disclosed in Table 1 as well as their orthologs.

A probe can hybridize to any nucleotide sequence along the entire length of a nucleic acid molecule provided in Table 1 and/or Table 2. Preferably, a probe of the present invention hybridizes to a region of a target sequence that encompasses a SNP position indicated in Table 1 and/or Table 2. More preferably, a probe hybridizes to a SNP-containing target sequence in a sequence-specific manner such that it distinguishes the target sequence from other nucleotide sequences which vary from the target sequence only by which nucleotide is present at the SNP site. Such a probe is particularly useful for detecting the presence of a SNP-containing nucleic acid in a test sample, or for determining which nucleotide (allele) is present at a particular SNP site (i.e., genotyping the SNP site).

A nucleic acid hybridization probe may be used for determining the presence, level, form, and/or distribution of nucleic acid expression. The nucleic acid whose level is determined can be DNA or RNA. Accordingly, probes specific for the SNPs described herein can be used to assess the presence, expression and/or gene copy number in a given cell, tissue, or organism. These uses are relevant for diagnosis of disorders involving an increase or decrease in gene expression relative to normal levels. In vitro techniques for detection of mRNA include, for example, Northern blot hybridizations and in situ hybridizations. In vitro techniques for detecting DNA include Southern blot hybridizations and in situ hybridizations (Sambrook and Russell, 2000, Molecular Cloning: A Laboratory Manual, Cold Spring Harbor Press, Cold Spring Harbor, N.Y.).

Probes can be used as part of a diagnostic test kit for identifying cells or tissues in which a variant protein is expressed, such as by measuring the level of a variant protein-encoding nucleic acid (e.g., mRNA) in a sample of cells from a subject or determining if a polynucleotide contains a SNP of interest.

Thus, the nucleic acid molecules of the invention can be used as hybridization probes to detect the SNPs disclosed herein, thereby determining whether an individual with the polymorphisms is at risk for psoriasis and related pathologies or has developed early stage psoriasis. Detection of a SNP associated with a disease phenotype provides a diagnostic tool for an active disease and/or genetic predisposition to the disease.

Furthermore, the nucleic acid molecules of the invention are therefore useful for detecting a gene (gene information is disclosed in Table 2, for example) which contains a SNP disclosed herein and/or products of such genes, such as expressed mRNA transcript molecules (transcript information is disclosed in Table 1, for example), and are thus useful for detecting gene expression. The nucleic acid molecules can optionally be implemented in, for example, an array or kit format for use in detecting gene expression.

The nucleic acid molecules of the invention are also useful as primers to amplify any given region of a nucleic acid molecule, particularly a region containing a SNP identified in Table 1 and/or Table 2.

The nucleic acid molecules of the invention are also useful for constructing recombinant vectors (described in greater detail below). Such vectors include expression vectors that express a portion of, or all of, any of the variant peptide sequences provided in Table 1. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced SNPs.

The nucleic acid molecules of the invention are also useful for expressing antigenic portions of the variant proteins, particularly antigenic portions that contain a variant amino acid sequence (e.g., an amino acid substitution) caused by a SNP disclosed in Table 1 and/or Table 2.

The nucleic acid molecules of the invention are also useful for constructing vectors containing a gene regulatory region of the nucleic acid molecules of the present invention.

The nucleic acid molecules of the invention are also useful for designing ribozymes corresponding to all, or a part, of an mRNA molecule expressed from a SNP-containing nucleic acid molecule described herein.

The nucleic acid molecules of the invention are also useful for constructing host cells expressing a part, or all, of the nucleic acid molecules and variant peptides.

The nucleic acid molecules of the invention are also useful for constructing transgenic animals expressing all, or a part, of the nucleic acid molecules and variant peptides. The production of recombinant cells and transgenic animals having nucleic acid molecules which contain the SNPs disclosed in Table 1 and/or Table 2 allow, for example, effective clinical design of treatment compounds and dosage regimens.

The nucleic acid molecules of the invention are also useful in assays for drug screening to identify compounds that, for example, modulate nucleic acid expression.

The nucleic acid molecules of the invention are also useful in gene therapy in patients whose cells have aberrant gene expression. Thus, recombinant cells, which include a patient's cells that have been engineered ex vivo and returned to the patient, can be introduced into an individual where the recombinant cells produce the desired protein to treat the individual.

SNP Genotyping Methods

The process of determining which specific nucleotide (i.e., allele) is present at each of one or more SNP positions, such as a SNP position in a nucleic acid molecule disclosed in Table 1 and/or Table 2, is referred to as SNP genotyping. The present invention provides methods of SNP genotyping, such as for use in screening for psoriasis or related pathologies, or determining predisposition thereto, or determining responsiveness to a form of treatment, or in genome mapping or SNP association analysis, etc.

Nucleic acid samples can be genotyped to determine which allele(s) is/are present at any given genetic region (e.g., SNP position) of interest by methods well known in the art. The neighboring sequence can be used to design SNP detection reagents such as oligonucleotide probes, which may optionally be implemented in a kit format. Exemplary SNP genotyping methods are described in Chen et al., "Single nucleotide polymorphism genotyping: biochemistry, protocol, cost and throughput", *Pharmacogenomics J.* 2003; 3(2):77-96; Kwok et al., "Detection of single nucleotide polymorphisms", *Curr Issues Mol Biol.* 2003 April; 5 (2):43-60; Shi, "Technologies for individual genotyping: detection of genetic polymorphisms in drug targets and disease genes", *Am J Pharmacogenomics.* 2002; 2 (3):197-205; and Kwok, "Methods for genotyping single nucleotide polymorphisms", *Annu Rev Genomics Hum Genet* 2001; 2:235-58. Exemplary techniques for high-throughput SNP genotyping are described in Marnellos, "High-throughput SNP analysis for genetic association studies", *Curr Opin Drug Discov Devel.* 2003 May; 6 (3):317-21. Common SNP genotyping methods include, but are not limited to, TaqMan assays, molecular beacon assays, nucleic acid arrays, allele-specific primer extension, allele-specific PCR, arrayed primer extension, homogeneous primer extension assays, primer extension with detection by mass spectrometry, pyrosequencing, multiplex primer extension sorted on genetic arrays, ligation with rolling circle amplification, homogeneous ligation, OLA (U.S. Pat. No. 4,988,167), multiplex ligation reaction sorted on genetic arrays, restriction-fragment length polymorphism, single base extension-tag assays, and the Invader assay. Such methods may be used in combination with detection mechanisms such as, for example, luminescence or chemiluminescence detection, fluorescence detection, time-resolved fluorescence detection, fluorescence resonance energy transfer, fluorescence polarization, mass spectrometry, and electrical detection.

Various methods for detecting polymorphisms include, but are not limited to, methods in which protection from cleavage agents is used to detect mismatched bases in RNA/RNA or RNA/DNA duplexes (Myers et al., *Science* 230:1242 (1985); Cotton et al, *PNAS* 85:4397 (1988); and Saleeba et al., *Meth. Enzymol.* 217:286-295 (1992)), comparison of the electrophoretic mobility of variant and wild type nucleic acid molecules (Orita et al., *PNAS* 86:2766 (1989); Cotton et al., *Mutat. Res.* 285:125-144 (1993); and Hayashi et al., *Genet. Anal. Tech. Appl.* 9:73-79 (1992)), and assaying the movement of polymorphic or wild-type fragments in polyacrylamide gels containing a gradient of denaturant using denaturing gradient gel electrophoresis (DGGE) (Myers et al., *Nature* 313:495 (1985)). Sequence variations at specific locations can also be assessed by nuclease protection assays such as RNase and S1 protection or chemical cleavage methods.

In a preferred embodiment, SNP genotyping is performed using the TaqMan assay, which is also known as the 5' nuclease assay (U.S. Pat. Nos. 5,210,015 and 5,538,848). The TaqMan assay detects the accumulation of a specific amplified product during PCR. The TaqMan assay utilizes an oligonucleotide probe labeled with a fluorescent reporter dye and a quencher dye. The reporter dye is excited by irradiation at an appropriate wavelength, it transfers energy to the quencher dye in the same probe via a process called fluorescence resonance energy transfer (FRET). When attached to the probe, the excited reporter dye does not emit a signal. The proximity of the quencher dye to the reporter dye in the intact probe maintains a reduced fluorescence for the reporter. The reporter dye and quencher dye may be at the 5' most and the 3' most ends, respectively, or vice versa. Alternatively, the reporter dye may be at the 5' or 3' most end while the quencher dye is attached to an internal nucleotide, or vice versa. In yet another embodiment, both the reporter and the quencher may be attached to internal nucleotides at a distance from each other such that fluorescence of the reporter is reduced.

During PCR, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The DNA polymerase cleaves the probe between the reporter dye and the quencher dye only if the probe hybridizes to the target SNP-containing template which is amplified during PCR, and the probe is designed to hybridize to the target SNP site only if a particular SNP allele is present.

Preferred TaqMan primer and probe sequences can readily be determined using the SNP and associated nucleic acid sequence information provided herein. A number of computer programs, such as Primer Express (Applied Biosystems, Foster City, Calif.), can be used to rapidly obtain optimal primer/probe sets. It will be apparent to one of skill in the art that such primers and probes for detecting the SNPs of the present invention are useful in diagnostic assays for psoriasis and related pathologies, and can be readily incorporated into a kit format. The present invention also includes modifications of the Taqman assay well known in the art such as the use of Molecular Beacon probes (U.S. Pat. Nos. 5,118,801 and 5,312,728) and other variant formats (U.S. Pat. Nos. 5,866,336 and 6,117,635).

Another preferred method for genotyping the SNPs of the present invention is the use of two oligonucleotide probes in an OLA (see, e.g., U.S. Pat. No. 4,988,617). In this method, one probe hybridizes to a segment of a target nucleic acid with its 3' most end aligned with the SNP site. A second probe hybridizes to an adjacent segment of the target nucleic acid molecule directly 3' to the first probe. The two juxtaposed probes hybridize to the target nucleic acid molecule, and are ligated in the presence of a linking agent such as a ligase if there is perfect complementarity between the 3' most nucleotide of the first probe with the SNP site. If there is a mismatch, ligation would not occur. After the reaction, the ligated probes are separated from the target nucleic acid molecule, and detected as indicators of the presence of a SNP.

The following patents, patent applications, and published international patent applications, which are all hereby incorporated by reference, provide additional information pertaining to techniques for carrying out various types of OLA: U.S. Pat. Nos. 6,027,889, 6,268,148, 5,494,810, 5,830,711, and 6,054,564 describe OLA strategies for performing SNP detection; WO 97/31256 and WO 00/56927 describe OLA strategies for performing SNP detection using universal arrays, wherein a zipcode sequence can be introduced into one of the hybridization probes, and the resulting product, or amplified product, hybridized to a universal zip code array readout; U.S. application US01/17329 (and 09/584,905) describes OLA (or LDR) followed by PCR, wherein zipcodes are incorporated into OLA probes, and amplified PCR products are determined by electrophoretic or universal zipcode array readout; U.S. applications 60/427,818, 60/445,636, and 60/445,494 describe SNPlex methods and software for multiplexed SNP detection using OLA followed by PCR, wherein zipcodes are incorporated into OLA probes, and amplified PCR products are hybridized with a zipchute reagent, and the identity of the SNP determined from electrophoretic readout of the zipchute. In some embodiments, OLA is carried out prior to PCR (or another method of nucleic acid amplification). In other embodiments, PCR (or another method of nucleic acid amplification) is carried out prior to OLA.

Another method for SNP genotyping is based on mass spectrometry. Mass spectrometry takes advantage of the unique mass of each of the four nucleotides of DNA. SNPs can be unambiguously genotyped by mass spectrometry by measuring the differences in the mass of nucleic acids having alternative SNP alleles. MALDI-TOF (Matrix Assisted Laser Desorption Ionization—Time of Flight) mass spectrometry technology is preferred for extremely precise determinations of molecular mass, such as SNPs. Numerous approaches to SNP analysis have been developed based on mass spectrometry. Preferred mass spectrometry-based methods of SNP genotyping include primer extension assays, which can also be utilized in combination with other approaches, such as traditional gel-based formats and microarrays.

Typically, the primer extension assay involves designing and annealing a primer to a template PCR amplicon upstream (5') from a target SNP position. A mix of dideoxynucleotide triphosphates (ddNTPs) and/or deoxynucleotide triphosphates (dNTPs) are added to a reaction mixture containing template (e.g., a SNP-containing nucleic acid molecule which has typically been amplified, such as by PCR), primer, and DNA polymerase. Extension of the primer terminates at the first position in the template where a nucleotide complementary to one of the ddNTPs in the mix occurs. The primer can be either immediately adjacent (i.e., the nucleotide at the 3' end of the primer hybridizes to the nucleotide next to the target SNP site) or two or more nucleotides removed from the SNP position. If the primer is several nucleotides removed from the target SNP position, the only limitation is that the template sequence between the 3' end of the primer and the SNP position cannot contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide upstream from the SNP position (i.e., the nucleotide at the 3' end of the primer hybridizes to the nucleotide that is immediately adjacent to the target SNP site on the 5' side of the target SNP site). Extension by only one nucleotide is preferable, as it minimizes the overall mass of the extended primer, thereby increasing the resolution of mass differences between alternative SNP nucleotides. Furthermore, mass-tagged ddNTPs can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers can then be purified and analyzed by MALDI-TOF mass spectrometry to determine the identity of the nucleotide present at the target SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule.

Ions with smaller m/z travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position. For further information regarding the use of primer extension assays in conjunction with MALDI-TOF mass spectrometry for SNP genotyping, see, e.g., Wise et al., "A standard protocol for single nucleotide primer extension in the human genome using matrix-assisted laser desorption/ionization time-of-flight mass spectrometry", *Rapid Commun Mass Spectrom.* 2003; 17(11): 1195-202.

The following references provide further information describing mass spectrometry-based methods for SNP genotyping: Bocker, "SNP and mutation discovery using base-specific cleavage and MALDI-TOF mass spectrometry", *Bioinformatics.* 2003 July; 19 Suppl 1:I44-I53; Storm et al., "MALDI-TOF mass spectrometry-based SNP genotyping", *Methods Mol Biol.* 2003; 212:241-62; Jurinke et al., "The use of Mass ARRAY technology for high throughput genotyping", *Adv Biochem Eng Biotechnol.* 2002; 77:57-74; and Jurinke et al., "Automated genotyping using the DNA MassArray technology", *Methods Mol Biol.* 2002; 187:179-92.

SNPs can also be scored by direct DNA sequencing. A variety of automated sequencing procedures can be utilized ((1995) *Biotechniques* 19:448), including sequencing by mass spectrometry (see, e.g., PCT International Publication No. WO94/16101; Cohen et al., *Adv. Chromatogr.* 36:127-162 (1996); and Griffin et al., *Appl. Biochem. Biotechnol.* 38:147-159 (1993)). The nucleic acid sequences of the present invention enable one of ordinary skill in the art to readily design sequencing primers for such automated sequencing procedures. Commercial instrumentation, such as the Applied Biosystems 377, 3100, 3700, 3730, and 3730×1 DNA Analyzers (Foster City, Calif.), is commonly used in the art for automated sequencing.

Other methods that can be used to genotype the SNPs of the present invention include single-strand conformational polymorphism (SSCP), and denaturing gradient gel electrophoresis (DGGE) (Myers et al., *Nature* 313:495 (1985)). SSCP identifies base differences by alteration in electrophoretic migration of single stranded PCR products, as described in Orita et al., *Proc. Nat. Acad.* Single-stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel (Erlich, ed., PCR Technology, *Principles and Applications for DNA Amplification*, W.H. Freeman and Co, New York, 1992, Chapter 7).

Sequence-specific ribozymes (U.S. Pat. No. 5,498,531) can also be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis SNP genotyping can include the steps of, for example, collecting a biological sample from a human subject (e.g., sample of tissues, cells, fluids, secretions, etc.), isolating nucleic acids (e.g., genomic DNA, mRNA or both) from the cells of the sample, contacting the nucleic acids with one or more primers which specifically hybridize to a region of the isolated nucleic acid containing a target SNP under conditions such that hybridization and amplification of the target nucleic acid region occurs, and determining the nucleotide present at the SNP position of interest, or, in some assays, detecting the presence or absence of an amplification product (assays can be designed so that hybridization and/or amplification will only occur if a particular SNP allele is present or absent). In some assays, the size of the amplification product is detected and compared to the length of a control sample; for example, deletions and insertions can be detected by a change in size of the amplified product compared to a normal genotype.

SNP genotyping is useful for numerous practical applications, as described below. Examples of such applications include, but are not limited to, SNP-disease association analysis, disease predisposition screening, disease diagnosis, disease prognosis, disease progression monitoring, determining therapeutic strategies based on an individual's genotype ("pharmacogenomics"), developing therapeutic agents based on SNP genotypes associated with a disease or likelihood of responding to a drug, stratifying a patient population for clinical trial for a treatment regimen, predicting the likelihood that an individual will experience toxic side effects from a therapeutic agent, and human identification applications such as forensics.

Analysis of Genetic Association Between SNPs and Phenotypic Traits

SNP genotyping for disease diagnosis, disease predisposition screening, disease prognosis, determining drug responsiveness (pharmacogenomics), drug toxicity screening, and other uses described herein, typically relies on initially establishing a genetic association between one or more specific SNPs and the particular phenotypic traits of interest.

Different study designs may be used for genetic association studies (*Modern Epidemiology*, Lippincott Williams & Wilkins (1998), 609-622). Observational studies are most frequently carried out in which the response of the patients is not interfered with. The first type of observational study identifies a sample of persons in whom the suspected cause of the disease is present and another sample of persons in whom the suspected cause is absent, and then the frequency of development of disease in the two samples is compared. These sampled populations are called cohorts, and the study is a prospective study. The other type of observational study is case-control or a retrospective study. In typical case-control studies, samples are collected from individuals with the phenotype of interest (cases) such as certain manifestations of a disease, and from individuals without the phenotype (controls) in a population (target population) that conclusions are to be drawn from. Then the possible causes of the disease are investigated retrospectively. As the time and costs of collecting samples in case-control studies are considerably less than those for prospective studies, case-control studies are the more commonly used study design in genetic association studies, at least during the exploration and discovery stage.

In both types of observational studies, there may be potential confounding factors that should be taken into consideration. Confounding factors are those that are associated with both the real cause(s) of the disease and the disease itself, and they include demographic information such as age, gender, ethnicity as well as environmental factors. When confounding factors are not matched in cases and controls in a study, and are not controlled properly, spurious association results can arise. If potential confounding factors are identified, they should be controlled for by analysis methods explained below.

In a genetic association study, the cause of interest to be tested is a certain allele or a SNP or a combination of alleles or a haplotype from several SNPs. Thus, tissue specimens (e.g., whole blood) from the sampled individuals may be collected and genomic DNA genotyped for the SNP(s) of interest. In addition to the phenotypic trait of interest, other information such as demographic (e.g., age, gender, ethnicity, etc.), clinical, and environmental information that may influence the outcome of the trait can be collected to further characterize and define the sample set. In many cases, these factors are known to be associated with diseases and/or SNP allele frequencies. There are likely gene-environment and/or gene-gene interactions as well. Analysis methods to address gene-environment and gene-gene interactions (for example, the effects of the presence of both susceptibility alleles at two different genes can be greater than the effects of the individual alleles at two genes combined) are discussed below.

After all the relevant phenotypic and genotypic information has been obtained, statistical analyses are carried out to determine if there is any significant correlation between the presence of an allele or a genotype with the phenotypic characteristics of an individual. Preferably, data inspection and cleaning are first performed before carrying out statistical tests for genetic association. Epidemiological and clinical data of the samples can be summarized by descriptive statistics with tables and graphs. Data validation is preferably performed to check for data completion, inconsistent entries, and outliers. Chi-squared tests and t-tests (Wilcoxon rank-sum tests if distributions are not normal) may then be used to check for significant differences between cases and controls for discrete and continuous variables, respectively. To ensure genotyping quality, Hardy-Weinberg disequilibrium tests can be performed on cases and controls separately. Significant deviation from Hardy-Weinberg equilibrium (HWE) in both cases and controls for individual markers can be indicative of genotyping errors. If HWE is violated in a majority of markers, it is indicative of population substructure that should be further investigated. Moreover, Hardy-Weinberg disequilibrium in cases only can indicate genetic association of the markers with the disease (*Genetic Data Analysis*, Weir B., Sinauer (1990)).

To test whether an allele of a single SNP is associated with the case or control status of a phenotypic trait, one skilled in the art can compare allele frequencies in cases and controls. Standard chi-squared tests and Fisher exact tests can be carried out on a 2×2 table (2 SNP alleles×2 outcomes in the categorical trait of interest). To test whether genotypes of a SNP are associated, chi-squared tests can be carried out on a 3×2 table (3 genotypes×2 outcomes). Score tests are also carried out for genotypic association to contrast the three genotypic frequencies (major homozygotes, heterozygotes and minor homozygotes) in cases and controls, and to look for trends using 3 different modes of inheritance, namely dominant (with contrast coefficients 2, −1, −1), additive (with contrast coefficients 1, 0, −1) and recessive (with contrast coefficients 1, 1, −2). Odds ratios for minor versus major alleles, and odds ratios for heterozygote and homozygote variants versus the wild type genotypes are calculated with the desired confidence limits, usually 95%.

In order to control for confounders and to test for interaction and effect modifiers, stratified analyses may be performed using stratified factors that are likely to be confounding, including demographic information such as age, ethnicity, and gender, or an interacting element or effect modifier, such as a known major gene (e.g., APOE for Alzheimer's disease or HLA genes for autoimmune diseases), or environmental factors such as smoking in lung cancer. Stratified association tests may be carried out using Cochran-Mantel-Haenszel tests that take into account the ordinal nature of genotypes with 0, 1, and 2 variant alleles. Exact tests by StatXact may also be performed when computationally possible. Another way to adjust for confounding effects and test for interactions is to perform stepwise multiple logistic regression analysis using statistical packages such as SAS or R. Logistic regression is a model-building technique in which the best fitting and most parsimonious model is built to describe the relation between the dichotomous outcome (for instance, getting a certain disease or not) and a set of independent variables (for instance, genotypes of different associated genes, and the associated demographic and environmental factors). The most common model is one in which the logit transformation of the odds ratios is expressed as a linear combination of the variables (main effects) and their cross-product terms (interactions) (Applied Logistic Regression, Hosmer and Lemeshow, Wiley (2000)). To test whether a certain variable or interaction is significantly associated with the outcome, coefficients in the model are first estimated and then tested for statistical significance of their departure from zero.

In addition to performing association tests one marker at a time, haplotype association analysis may also be performed to study a number of markers that are closely linked together. Haplotype association tests can have better power than genotypic or allelic association tests when the tested markers are not the disease-causing mutations themselves but are in linkage disequilibrium with such mutations. The test will even be more powerful if the disease is indeed caused by a combination of alleles on a haplotype (e.g., APOE is a haplotype formed by 2 SNPs that are very close to each other). In order to perform haplotype association effectively, marker-marker linkage disequilibrium measures, both D' and $R^2$, are typically calculated for the markers within a gene to elucidate the haplotype structure. Recent studies (Daly et al, *Nature Genetics*, 29, 232-235, 2001) in linkage disequilibrium indicate that SNPs within a gene are organized in block pattern, and a high degree of linkage disequilibrium exists within blocks and very little linkage disequilibrium exists between blocks. Haplotype association with the disease status can be performed using such blocks once they have been elucidated.

Haplotype association tests can be carried out in a similar fashion as the allelic and genotypic association tests. Each haplotype in a gene is analogous to an allele in a multi-allelic marker. One skilled in the art can either compare the haplotype frequencies in cases and controls or test genetic association with different pairs of haplotypes. It has been proposed (Schaid et al, *Am. J. Hum. Genet.*, 70, 425-434, 2002) that score tests can be done on haplotypes using the program "haplo.score". In that method, haplotypes are first inferred by EM algorithm and score tests are carried out with a generalized linear model (GLM) framework that allows the adjustment of other factors.

An important decision in the performance of genetic association tests is the determination of the significance level at which significant association can be declared when the p-value of the tests reaches that level. In an exploratory analysis where positive hits will be followed up in subsequent confirmatory testing, an unadjusted p-value<0.2 (a significance level on the lenient side), for example, may be used for generating hypotheses for significant association of a SNP with certain phenotypic characteristics of a disease. It is preferred that a p-value<0.05 (a significance level traditionally used in the art) is achieved in order for a SNP to be considered to have an association with a disease. It is more preferred that a p-value<0.01 (a significance level on the stringent side) is achieved for an association to be declared. When hits are followed up in confirmatory analyses in more samples of the same source or in different samples from different sources, adjustment for multiple testing will be performed as to avoid excess number of hits while maintaining the experiment-wise error rates at 0.05. While there are different methods to adjust for multiple testing to control for different kinds of error rates, a commonly used but rather conservative method is Bonferroni correction to control the experiment-wise or family-wise error rate (*Multiple comparisons and multiple tests*, Westfall et al, SAS Institute (1999)). Permutation tests to control for the false discovery rates, FDR, can be more powerful (Benjamini and Hochberg, Journal of the Royal Statistical Society, Series B 57, 1289-1300, 1995, *Resampling-based Multiple Testing*, Westfall and Young, Wiley (1993)). Such methods to control for multiplicity would be preferred when the tests are dependent and controlling for false discovery rates is sufficient as opposed to controlling for the experiment-wise error rates.

In replication studies using samples from different populations after statistically significant markers have been identified in the exploratory stage, meta-analyses can then be performed by combining evidence of different studies (*Modern Epidemiology*, Lippincott Williams & Wilkins, 1998, 643-673). If available, association results known in the art for the same SNPs can be included in the meta-analyses.

Since both genotyping and disease status classification can involve errors, sensitivity analyses may be performed to see how odds ratios and p-values would change upon various estimates on genotyping and disease classification error rates.

It has been well known that subpopulation-based sampling bias between cases and controls can lead to spurious results in case-control association studies (Ewens and Spielman, *Am. J. Hum. Genet.* 62, 450-458, 1995) when prevalence of the disease is associated with different subpopulation groups. Such bias can also lead to a loss of statistical power in genetic association studies. To detect population stratification, Pritchard and Rosenberg (Pritchard et al. *Am. J. Hum. Gen.* 1999, 65:220-228) suggested typing markers that are unlinked to the disease and using results of association tests on those markers to determine whether there is any population stratification. When stratification is detected, the genomic control (GC) method as proposed by Devlin and Roeder (Devlin et al. *Biometrics* 1999, 55:997-1004) can be used to adjust for the inflation of test statistics due to population stratification. GC method is robust to changes in population structure levels as well as being applicable to DNA pooling designs (Devlin et al. *Genet. Epidem.* 20001, 21:273-284).

While Pritchard's method recommended using 15-20 unlinked microsatellite markers, it suggested using more than 30 biallelic markers to get enough power to detect population stratification. For the GC method, it has been shown (Bacanu et al. *Am. J. Hum. Genet.* 2000, 66:1933-1944) that about 60-70 biallelic markers are sufficient to estimate the inflation factor for the test statistics due to population stratification. Hence, 70 intergenic SNPs can be chosen in unlinked regions as indicated in a genome scan (Kehoe et al. *Hum. Mol. Genet.* 1999, 8:237-245).

Once individual risk factors, genetic or non-genetic, have been found for the predisposition to disease, the next step is to set up a classification/prediction scheme to predict the category (for instance, disease or no-disease) that an individual will be in depending on his genotypes of associated SNPs and other non-genetic risk factors. Logistic regression for discrete trait and linear regression for continuous trait are standard techniques for such tasks (*Applied Regression Analysis*, Draper and Smith, Wiley (1998)). Moreover, other techniques can also be used for setting up classification. Such techniques include, but are not limited to, MART, CART, neural network, and discriminant analyses that are suitable for use in comparing the performance of different methods (*The Elements of Statistical Learning*, Hastie, Tibshirani & Friedman, Springer (2002)).

Disease Diagnosis and Predisposition Screening

Information on association/correlation between genotypes and disease-related phenotypes can be exploited in several ways. For example, in the case of a highly statistically significant association between one or more SNPs with predisposition to a disease for which treatment is available, detection of such a genotype pattern in an individual may justify immediate administration of treatment, or at least the institution of regular monitoring of the individual. Detection of the susceptibility alleles associated with serious disease in a couple contemplating having children may also be valuable to the couple in their reproductive decisions. In the case of a weaker but still statistically significant association between a SNP and a human disease, immediate therapeutic intervention or monitoring may not be justified after detecting the susceptibility allele or SNP. Nevertheless, the subject can be motivated to begin simple life-style changes (e.g., diet, exercise) that can be accomplished at little or no cost to the individual but would confer potential benefits in reducing the risk of developing conditions for which that individual may have an increased risk by virtue of having the susceptibility allele(s).

The SNPs of the invention may contribute to psoriasis and related pathologies in an individual in different ways. Some polymorphisms occur within a protein coding sequence and contribute to disease phenotype by affecting protein structure. Other polymorphisms occur in noncoding regions but may exert phenotypic effects indirectly via influence on, for example, replication, transcription, and/or translation. A single SNP may affect more than one phenotypic trait. Likewise, a single phenotypic trait may be affected by multiple SNPs in different genes.

As used herein, the terms "diagnose", "diagnosis", and "diagnostics" include, but are not limited to any of the following: detection of psoriasis that an individual may presently have, predisposition/susceptibility screening (i.e., determining the increased risk of an individual in developing psoriasis in the future, or determining whether an individual has a decreased risk of developing psoriasis in the future, determining a particular type or subclass of psoriasis in an individual known to have psoriasis, confirming or reinforcing a previously made diagnosis of psoriasis, pharmacogenomic evaluation of an individual to determine which therapeutic strategy that individual is most likely to positively respond to or to predict whether a patient is likely to respond to a particular treatment, predicting whether a patient is likely to experience toxic effects from a particular treatment or therapeutic compound, and evaluating the future prognosis of an individual having psoriasis. Such diagnostic uses are based on the SNPs individually or in a unique combination or SNP haplotypes of the present invention.

Haplotypes are particularly useful in that, for example, fewer SNPs can be genotyped to determine if a particular genomic region harbors a locus that influences a particular phenotype, such as in linkage disequilibrium-based SNP association analysis.

Linkage disequilibrium (LD) refers to the co-inheritance of alleles (e.g., alternative nucleotides) at two or more different SNP sites at frequencies greater than would be expected from the separate frequencies of occurrence of each allele in a given population. The expected frequency of co-occurrence of two alleles that are inherited independently is the frequency of the first allele multiplied by the frequency of the second allele. Alleles that co-occur at expected frequencies are said to be in "linkage equilibrium". In contrast, LD refers to any non-random genetic association between allele(s) at two or more different SNP sites, which is generally due to the physical proximity of the two loci along a chromosome. LD can occur when two or more SNPs sites are in close physical proximity to each other on a given chromosome and therefore alleles at these SNP sites will tend to remain unseparated for multiple generations with the consequence that a particular nucleotide (allele) at one SNP site will show a non-random association with a particular nucleotide (allele) at a different SNP site located nearby. Hence, genotyping one of the SNP sites will give almost the same information as genotyping the other SNP site that is in LD.

Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome.

For diagnostic purposes and similar uses, if a particular SNP site is found to be useful for diagnosing psoriasis and related pathologies (e.g., has a significant statistical association with the condition and/or is recognized as a causative polymorphism for the condition), then the skilled artisan would recognize that other SNP sites which are in LD with this SNP site would also be useful for diagnosing the condition. Thus, polymorphisms (e.g., SNPs and/or haplotypes) that are not the actual disease-causing (causative) polymorphisms, but are in LD with such causative polymorphisms, are also useful. In such instances, the genotype of the polymorphism(s) that is/are in LD with the causative polymorphism is predictive of the genotype of the causative polymorphism and, consequently, predictive of the phenotype (e.g., psoriasis) that is influenced by the causative SNP(s). Therefore, polymorphic markers that are in LD with causative polymorphisms are useful as diagnostic markers, and are particularly useful when the actual causative polymorphism(s) is/are unknown.

Examples of polymorphisms that can be in LD with one or more causative polymorphisms (and/or in LD with one or more polymorphisms that have a significant statistical association with a condition) and therefore useful for diagnosing the same condition that the causative/associated SNP(s) is used to diagnose, include, for example, other SNPs in the same gene, protein-coding, or mRNA transcript-coding region as the causative/associated SNP, other SNPs in the same exon or same intron as the causative/associated SNP, other SNPs in the same haplotype block as the causative/associated SNP, other SNPs in the same intergenic region as the causative/associated SNP, SNPs that are outside but near a gene (e.g., within 6 kb on either side, 5' or 3', of a gene boundary) that harbors a causative/associated SNP, etc. Such useful LD SNPs can be selected from among the SNPs disclosed in Tables 1-3, for example.

Linkage disequilibrium in the human genome is reviewed in the following references: Wall et al. et al., "Haplotype blocks and linkage disequilibrium in the human genome,", *Nat Rev Genet.* 2003 August; 4(8):587-97 (August 2003); Garner et al. et al., "On selecting markers for association studies: patterns of linkage disequilibrium between two and three diallelic loci,", *Genet Epidemiol.* 2003 January; 24(1): 57-67 (January 2003); Ardlie et al. et al., "Patterns of linkage disequilibrium in the human genome,", *Nat Rev Genet.* 2002 April; 3(4):299-309 (April 2002); (erratum in *Nat Rev Genet* 2002 July; 3(7):566 (July 2002); and Remm et al. et al., "High-density genotyping and linkage disequilibrium in the human genome using chromosome 22 as a model,"; *Curr Opin Chem Biol.* 2002 February; 6(1):24-30 (February 2002); J. B. S. Haldane, "J B S (1919) The combination of linkage values, and the calculation of distances between the loci of linked factors,". *J Genet.* 8:299-309 (1919); G. Mendel, G. (1866) *Versuche über Pflanzen-Hybriden. Verhandlungen des naturforschenden Vereines in Brünn* [(*Proceedings of the Natural History Society of Brünn*)] (1866); Lewin B (1990) *Genes IV*, B. Lewin, ed., Oxford University Press, N.Y. ew York, USA (1990); D. L. Hartl D L and A. G. Clark A G (1989) *Principles of Population Genetics* $2^{nd}$ ed., Sinauer Associates, Inc., Ma Sunderland, Mass., USA (1989); J. H. Gillespie J H (2004) *Population Genetics: A Concise Guide.* $2^{nd}$ ed., Johns Hopkins University Press. (2004) USA; R. C. Lewontin, "R C (1964) The interaction of selection and linkage. I. General considerations; heterotic models,". *Genetics* 49:49-67 (1964); P. G. Hoel, P G (1954) *Introduction to Mathematical Statistics* $2^{nd}$ ed., John Wiley & Sons, Inc., N.Y. New York, USA (1954); R. R. Hudson, R R "(2001) Two-locus sampling distributions and their application,". *Genetics* 159:1805-1817 (2001); A. P. Dempster A P, N. M. Laird, D. B. N M, Rubin, "D B (1977) Maximum likelihood from incomplete data via the EM algorithm,". *J R Stat Soc* 39:1-38 (1977); L. Excoffier L, M. Slatkin, M "(1995) Maximum-likelihood estimation of molecular haplotype frequencies in a diploid population,". *Mol Biol Evol* 12(5):921-927 (1995); D. A. Tregouet D A, S. Escolano S, L. Tiret L, A. Mallet A, J. L. Golmard, J L "(2004) A new algorithm for haplotype-based association analysis: the Stochastic-EM algorithm,". *Ann Hum Genet.* 68(Pt 2):165-177 (2004); A. D. Long A D and C. H. Langley C H, "(1999) The power of association studies to detect the contribution of candidate genetic loci to variation in complex traits,". *Genome Research* 9:720-731 (1999); A. Agresti, A (1990) *Categorical Data Analysis*, John Wiley & Sons, Inc., N.Y. New York, USA (1990); K. Lange, K (1997) *Mathematical and Statistical Methods for Genetic Analysis*, Springer-Verlag New York, Inc., N.Y. New York, USA (1997); The International HapMap Consortium, "(2003) The International HapMap Project,". *Nature* 426:789-796 (2003); The International HapMap Consortium, "(2005) A haplotype map of the human genome,". *Nature* 437:1299-1320 (2005); G. A. Thorisson G A, A. V. Smith A V, L. Krishnan L, L. D. Stein L D (2005), "The International HapMap Project Web Site,". *Genome Research* 15:1591-1593 (2005); G. McVean, C. C. A. G, Spencer C C A, R. Chaix R (2005), "Perspectives on human genetic variation from the HapMap project,". *PLoS Genetics* 1(4):413-418 (2005); J. N. Hirschhorn J N, M. J. Daly, M J "(2005) Genome-wide association studies for common diseases and complex traits,". *Nat Genet* 6:95-108 (2005); S. J. Schrodi, "S J (2005) A probabilistic approach to large-scale association scans: a semi-Bayesian method to detect disease-predisposing alleles,". *SAGMB* 4(1):31 (2005); W. Y. S. Wang W Y S, B.

J. Barratt B J, D. G. Clayton D G, J. A. Todd, "J A (2005) Genome-wide association studies: theoretical and practical concerns,". *Nat Rev Genet* 6:109-118 (2005); J. K. Pritchard J K, M. Przeworski, "M (2001) Linkage disequilibrium in humans: models and data,". *Am J Hum Genet* 69:1-14 (2001).

As discussed above, one aspect of the present invention is the discovery that SNPs which are in certain LD distance with the interrogated SNP can also be used as valid markers for identifying an increased or decreased risks of having or developing psoriasis. As used herein, the term "interrogated SNP" refers to SNPs that have been found to be associated with an increased or decreased risk of disease using genotyping results and analysis, or other appropriate experimental method as exemplified in the working examples described in this application. As used herein, the term "LD SNP" refers to a SNP that has been characterized as a SNP associating with an increased or decreased risk of diseases due to their being in LD with the "interrogated SNP" under the methods of calculation described in the application. Below, applicants describe the methods of calculation with which one of ordinary skilled in the art may determine if a particular SNP is in LD with an interrogated SNP. The parameter $r^2$ is commonly used in the genetics art to characterize the extent of linkage disequilibrium between markers (Hudson, 2001). As used herein, the term "in LD with" refers to a particular SNP that is measured at above the threshold of a parameter such as $r^2$ with an interrogated SNP.

It is now common place to directly observe genetic variants in a sample of chromosomes obtained from a population. Suppose one has genotype data at two genetic markers located on the same chromosome, for the markers A and B. Further suppose that two alleles segregate at each of these two markers such that alleles $A_1$ and $A_2$ can be found at marker A and alleles $B_1$ and $B_2$ at marker B. Also assume that these two markers are on a human autosome. If one is to examine a specific individual and find that they are heterozygous at both markers, such that their two-marker genotype is $A_1A_2B_1B_2$, then there are two possible configurations: the individual in question could have the alleles $A_1B_1$ on one chromosome and $A_2B_2$ on the remaining chromosome; alternatively, the individual could have alleles $A_1B_2$ on one chromosome and $A_2B_1$ on the other. The arrangement of alleles on a chromosome is called a haplotype. In this illustration, the individual could have haplotypes $A_1B_1/A_2B_2$ or $A_1B_2/A_2B_1$ (see Hartl and Clark (1989) for a more complete description). The concept of linkage equilibrium relates the frequency of haplotypes to the allele frequencies.

Assume that a sample of individuals is selected from a larger population. Considering the two markers described above, each having two alleles, there are four possible haplotypes: $A_1B_1$, $A_1B_2$, $A_2B_1$ and $A_2B_2$. Denote the frequencies of these four haplotypes with the following notation.

$$P_{11}=\text{freq}(A_1B_1) \tag{1}$$

$$P_{12}=\text{freq}(A_1B_2) \tag{2}$$

$$P_{21}=\text{freq}(A_2B_1) \tag{3}$$

$$P_{22}=\text{freq}(A_2B_2) \tag{4}$$

The allele frequencies at the two markers are then the sum of different haplotype frequencies, it is straightforward to write down a similar set of equations relating single-marker allele frequencies to two-marker haplotype frequencies:

$$p_1=\text{freq}(A_1)=P_{11}+P_{12} \tag{5}$$

$$p_2=\text{freq}(A_2)=P_{21}+P_{22} \tag{6}$$

$$q_1=\text{freq}(B_1)=P_{11}+P_{21} \tag{7}$$

$$q_2=\text{freq}(B_2)=P_{12}+P_{22} \tag{8}$$

Note that the four haplotype frequencies and the allele frequencies at each marker must sum to a frequency of 1.

$$P_{11}+P_{12}+P_{21}+P_{22}=1 \tag{9}$$

$$p_1+p_2=1 \tag{10}$$

$$q_1+q_2=1 \tag{11}$$

If there is no correlation between the alleles at the two markers, one would expect that the frequency of the haplotypes would be approximately the product of the composite alleles. Therefore, $$P_{11} \approx p_1 q_1 \tag{12}$$

$$P_{12} \approx p_1 q_2 \tag{13}$$

$$P_{21} \approx p_2 q_1 \tag{14}$$

$$P_{22} \approx p_2 q_2 \tag{15}$$

These approximating equations (12)-(15) represent the concept of linkage equilibrium where there is independent assortment between the two markers—the alleles at the two markers occur together at random. These are represented as approximations because linkage equilibrium and linkage disequilibrium are concepts typically thought of as properties of a sample of chromosomes; and as such they are susceptible to stochastic fluctuations due to the sampling process. Empirically, many pairs of genetic markers will be in linkage equilibrium, but certainly not all pairs.

Having established the concept of linkage equilibrium above, applicants can now describe the concept of linkage disequilibrium (LD), which is the deviation from linkage equilibrium. Since the frequency of the $A_1B_1$ haplotype is approximately the product of the allele frequencies for $A_1$ and $B_1$ under the assumption of linkage equilibrium as stated mathematically in (12), a simple measure for the amount of departure from linkage equilibrium is the difference in these two quantities, D, $$D=P_{11}-p_1q_1 \tag{16}$$

D=0 indicates perfect linkage equilibrium. Substantial departures from D=0 indicates LD in the sample of chromosomes examined. Many properties of D are discussed in Lewontin (1964) including the maximum and minimum values that D can take. Mathematically, using basic algebra, it can be shown that D can also be written solely in terms of haplotypes:

$$D=P_{11}P_{22}-P_{12}P_{21} \tag{17}$$

If one transforms D by squaring it and subsequently dividing by the product of the allele frequencies of $A_1$, $A_2$, $B_1$ and $B_2$, the resulting quantity, called $r^2$, is equivalent to the square of the Pearson's correlation coefficient commonly used in statistics (e.g. Hoel, 1954).

$$r^2 = \frac{D^2}{p_1 p_2 q_1 q_2} \tag{18}$$

As with D, values of $r^2$ close to 0 indicate linkage equilibrium between the two markers examined in the sample set. As values of $r^2$ increase, the two markers are said to be in linkage disequilibrium. The range of values that $r^2$ can take are from 0 to 1. $r^2=1$ when there is a perfect correlation between the alleles at the two markers.

In addition, the quantities discussed above are sample-specific. And as such, it is necessary to formulate notation specific to the samples studied. In the approach discussed here, three types of samples are of primary interest: (i) a sample of chromosomes from individuals affected by a disease-related phenotype (cases), (ii) a sample of chromosomes obtained from individuals not affected by the disease-related phenotype (controls), and (iii) a standard sample set used for the construction of haplotypes and calculation pairwise linkage disequilibrium. For the allele frequencies used in the development of the method described below, an additional subscript will be added to denote either the case or control sample sets.

$$p_{1,cs} = \text{freq}(A_1 \text{ in cases}) \quad (19)$$

$$p_{2,cs} = \text{freq}(A_2 \text{ in cases}) \quad (20)$$

$$q_{1,cs} = \text{freq}(B_1 \text{ in cases}) \quad (21)$$

$$q_{2,cs} = \text{freq}(B_2 \text{ in cases}) \quad (22)$$

Similarly, $$p_{1,ct} = \text{freq}(A_1 \text{ in controls}) \quad (23)$$

$$p_{2,ct} = \text{freq}(A_2 \text{ in controls}) \quad (24)$$

$$q_{1,ct} = \text{freq}(B_1 \text{ in controls}) \quad (25)$$

$$q_{2,ct} = \text{freq}(B_2 \text{ in controls}) \quad (26)$$

As a well-accepted sample set is necessary for robust linkage disequilibrium calculations, data obtained from the International HapMap project (The International HapMap Consortium 2003, 2005; Thorisson et al, 2005; McVean et al, 2005) can be used for the calculation of pairwise $r^2$ values. Indeed, the samples genotyped for the International HapMap Project were selected to be representative examples from various human sub-populations with sufficient numbers of chromosomes examined to draw meaningful and robust conclusions from the patterns of genetic variation observed. The International HapMap project website (hapmap.org) contains a description of the project, methods utilized and samples examined. It is useful to examine empirical data to get a sense of the patterns present in such data.

Haplotype frequencies were explicit arguments in equation (18) above. However, knowing the 2-marker haplotype frequencies requires that phase to be determined for doubly heterozygous samples. When phase is unknown in the data examined, various algorithms can be used to infer phase from the genotype data. This issue was discussed earlier where the doubly heterozygous individual with a 2-SNP genotype of $A_1A_2B_1B_2$ could have one of two different sets of chromosomes: $A_1B_1/A_2B_2$ or $A_1B_2/A_2B_1$. One such algorithm to estimate haplotype frequencies is the expectation-maximization (EM) algorithm first formalized by Dempster et al et al. (1977). This algorithm is often used in genetics to infer haplotype frequencies from genotype data (e.g. e.g. Excoffier and Slatkin (, 1995); Tregouet et al et al., (2004)). It should be noted that for the two-SNP case explored here, EM algorithms have very little error provided that the allele frequencies and sample sizes are not too small. The impact on $r^2$ values is typically negligible.

As correlated genetic markers share information, interrogation of SNP markers in LD with a disease-associated SNP marker can also have sufficient power to detect disease association (Long and Langley (, 1999)). The relationship between the power to directly find disease-associated alleles and the power to indirectly detect disease-association was investigated by Pritchard and Przeworski (2001). In a straight-forward derivation, it can be shown that the power to detect disease association indirectly at a marker locus in linkage disequilibrium with a disease-association locus is approximately the same as the power to detect disease-association directly at the disease-association locus if the sample size is increased by a factor of $$\frac{1}{r^2}$$

(the reciprocal of equation 18) at the marker in comparison with the disease-association locus.

Therefore, if one calculated the power to detect disease-association indirectly with an experiment having N samples, then equivalent power to directly detect disease-association (at the actual disease-susceptibility locus) would necessitate an experiment using approximately $r^2N$ samples. This elementary relationship between power, sample size and linkage disequilibrium can be used to derive an $r^2$ threshold value useful in determining whether or not genotyping markers in linkage disequilibrium with a SNP marker directly associated with disease status has enough power to indirectly detect disease-association.

To commence a derivation of the power to detect disease-associated markers through an indirect process, define the effective chromosomal sample size as $$n = \frac{4N_{cs}N_{ct}}{N_{cs} + N_{ct}}; \quad (27)$$

where $N_{cs}$ and $N_{ct}$ are the numbers of diploid cases and controls, respectively. This is necessary to handle situations where the numbers of cases and controls are not equivalent. For equal case and control sample sizes, $N_{cs}=N_{ct}=N$, the value of the effective number of chromosomes is simply n=2N—as expected. Let power be calculated for a significance level α (such that traditional P-values below α will be deemed statistically significant). Define the standard Gaussian distribution function as Φ(•). Mathematically, $$\Phi(x) = \frac{1}{\sqrt{2\pi}} \int_{-\infty}^{x} e^{-\frac{\theta^2}{2}} d\theta \quad (28)$$

Alternatively, the following error function notation (Erf) may also be used, $$\Phi(x) = \frac{1}{2}\left[1 + \text{Erf}\left(\frac{x}{\sqrt{2}}\right)\right] \quad (29)$$

For example, Φ(1.644854)=0.95. The value of $r^2$ may be derived to yield a pre-specified minimum amount of power to detect disease association though indirect interrogation. Noting that the LD SNP marker could be the one that is carrying the disease-association allele, therefore that this approach constitutes a lower-bound model where all indirect power results are expected to be at least as large as those interrogated.

Denote by β the error rate for not detecting truly disease-associated markers. Therefore, 1−β is the classical definition of statistical power. Substituting the Pritchard-Pzreworski result into the sample size, the power to detect disease association at a significance level of α is given by the approximation $$1 - \beta \cong \Phi\left[\frac{|q_{1,cs} - q_{1,ct}|}{\sqrt{\frac{q_{1,cs}(1 - q_{1,cs}) + q_{1,ct}(1 - q_{1,ct})}{r^2 n}}} - Z_{1-\alpha/2}\right]; \quad (30)$$

where $Z_u$ is the inverse of the standard normal cumulative distribution evaluated at u (u ∈ (0,1)). $Z_u = \Phi^{-1}(u)$, where $\Phi(\Phi^{-1}(u)) = \Phi^{-1}(\Phi(u)) = u$. For example, setting α=0.05, and therefore 1−α/2=0.975, $Z_{0.975}$=1.95996 is obtained. Next, setting power equal to a threshold of a minimum power of T, $$T = \Phi\left[\frac{|q_{1,cs} - q_{1,ct}|}{\sqrt{\frac{q_{1,cs}(1 - q_{1,cs}) + q_{1,ct}(1 - q_{1,ct})}{r^2 n}}} - Z_{1-\alpha/2}\right] \quad (31)$$

and solving for $r^2$, the following threshold $r^2$ is obtained:

$$r_T^2 = \frac{[q_{1,cs}(1 - q_{1,cs}) + q_{1,ct}(1 - q_{1,ct})]}{n(q_{1,cs} - q_{1,ct})^2}[\Phi^{-1}(T) + Z_{1-\alpha/2}]^2 \quad (32)$$

Or, $$r_T^2 = \frac{(Z_T + Z_{1-\alpha/2})^2}{n}\left[\frac{q_{1,cs} - (q_{1,cs})^2 + q_{1,ct} - (q_{1,ct})^2}{(q_{1,cs} - q_{1,ct})^2}\right] \quad (33)$$

Suppose that $r^2$ is calculated between an interrogated SNP and a number of other SNPs with varying levels of LD with the interrogated SNP. The threshold value $r_T^2$ is the minimum value of linkage disequilibrium between the interrogated SNP and the potential LD SNPs such that the LD SNP still retains a power greater or equal to T for detecting disease-association. For example, suppose that SNP rs200 is genotyped in a case-control disease-association study and it is found to be associated with a disease phenotype. Further suppose that the minor allele frequency in 1,000 case chromosomes was found to be 16% in contrast with a minor allele frequency of 10% in 1,000 control chromosomes. Given those measurements one could have predicted, prior to the experiment, that the power to detect disease association at a significance level of 0.05 was quite high—approximately 98% using a test of allelic association. Applying equation (32) one can calculate a minimum value of $r^2$ to indirectly assess disease association assuming that the minor allele at SNP rs200 is truly disease-predisposing for a threshold level of power. If one sets the threshold level of power to be 80%, then $r_T^2$=0.489 given the same significance level and chromosome numbers as above. Hence, any SNP with a pairwise $r^2$ value with rs200 greater than 0.489 is expected to have greater than 80% power to detect the disease association. Further, this is assuming the conservative model where the LD SNP is disease-associated only through linkage disequilibrium with the interrogated SNP rs200.

The contribution or association of particular SNPs and/or SNP haplotypes with disease phenotypes, such as psoriasis, enables the SNPs of the present invention to be used to develop superior diagnostic tests capable of identifying individuals who express a detectable trait, such as psoriasis, as the result of a specific genotype, or individuals whose genotype places them at an increased or decreased risk of developing a detectable trait at a subsequent time as compared to individuals who do not have that genotype. As described herein, diagnostics may be based on a single SNP or a group of SNPs. Combined detection of a plurality of SNPs (for example, 2, 3, 4, 5, 6, 7, 8, 9, 10, 11, 12, 13, 14, 15, 16, 17, 18, 19, 20, 24, 25, 30, 32, 48, 50, 64, 96, 100, or any other number in-between, or more, of the SNPs provided in Table 1 and/or Table 2) typically increases the probability of an accurate diagnosis. For example, the presence of a single SNP known to correlate with psoriasis might indicate a probability of 20% that an individual has or is at risk of developing psoriasis, whereas detection of five SNPs, each of which correlates with psoriasis, might indicate a probability of 80% that an individual has or is at risk of developing psoriasis. To further increase the accuracy of diagnosis or predisposition screening, analysis of the SNPs of the present invention can be combined with that of other polymorphisms or other risk factors of psoriasis, such as disease symptoms, pathological characteristics, family history, diet, environmental factors or lifestyle factors.

It will, of course, be understood by practitioners skilled in the treatment or diagnosis of psoriasis that the present invention generally does not intend to provide an absolute identification of individuals who are at risk (or less at risk) of developing psoriasis, and/or pathologies related to psoriasis, but rather to indicate a certain increased (or decreased) degree or likelihood of developing the disease based on statistically significant association results. However, this information is extremely valuable as it can be used to, for example, initiate preventive treatments or to allow an individual carrying one or more significant SNPs or SNP haplotypes to foresee warning signs such as minor clinical symptoms, or to have regularly scheduled physical exams to monitor for appearance of a condition in order to identify and begin treatment of the condition at an early stage. Particularly with diseases that are extremely debilitating or fatal if not treated on time, the knowledge of a potential predisposition, even if this predisposition is not absolute, would likely contribute in a very significant manner to treatment efficacy.

The diagnostic techniques of the present invention may employ a variety of methodologies to determine whether a test subject has a SNP or a SNP pattern associated with an increased or decreased risk of developing a detectable trait or whether the individual suffers from a detectable trait as a result of a particular polymorphism/mutation, including, for example, methods which enable the analysis of individual chromosomes for haplotyping, family studies, single sperm DNA analysis, or somatic hybrids. The trait analyzed using the diagnostics of the invention may be any detectable trait that is commonly observed in pathologies and disorders related to psoriasis.

Another aspect of the present invention relates to a method of determining whether an individual is at risk (or less at risk) of developing one or more traits or whether an individual expresses one or more traits as a consequence of possessing a particular trait-causing or trait-influencing allele. These methods generally involve obtaining a nucleic acid sample from an individual and assaying the nucleic acid sample to determine which nucleotide(s) is/are present at one or more SNP positions, wherein the assayed nucleotide(s) is/are indicative of an increased or decreased risk of developing the trait or indicative that the individual expresses the trait as a result of possessing a particular trait-causing or trait-influencing allele.

In another embodiment, the SNP detection reagents of the present invention are used to determine whether an individual has one or more SNP allele(s) affecting the level (e.g., the concentration of mRNA or protein in a sample, etc.) or pattern (e.g., the kinetics of expression, rate of decomposition, stability profile, Km, Vmax, etc.) of gene expression (collectively, the "gene response" of a cell or bodily fluid). Such a determination can be accomplished by screening for mRNA or protein expression (e.g., by using nucleic acid arrays, RT-PCR, TaqMan assays, or mass spectrometry), identifying genes having altered expression in an individual, genotyping SNPs disclosed in Table 1 and/or Table 2 that could affect the expression of the genes having altered expression (e.g., SNPs that are in and/or around the gene(s) having altered expression, SNPs in regulatory/control regions, SNPs in and/or around other genes that are involved in pathways that could affect the expression of the gene(s) having altered expression, or all SNPs could be genotyped), and correlating SNP genotypes with altered gene expression. In this manner, specific SNP alleles at particular SNP sites can be identified that affect gene expression.

Pharmacogenomics and Therapeutics/Drug Development

The present invention provides methods for assessing the pharmacogenomics of a subject harboring particular SNP alleles or haplotypes or diplotypes to a particular therapeutic agent or pharmaceutical compound, or to a class of such compounds. Pharmacogenomics deals with the roles which clinically significant hereditary variations (e.g., SNPs) play in the response to drugs due to altered drug disposition and/or abnormal action in affected persons. See, e.g., Roses, Nature 405, 857-865 (2000); Gould Rothberg, Nature Biotechnology 19, 209-211 (2001); Eichelbaum, Clin. Exp. Pharmacol. Physiol. 23(10-11):983-985 (1996); and Linder, Clin. Chem. 43(2):254-266 (1997). The clinical outcomes of these variations can result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. For example, SNPs in drug metabolizing enzymes can affect the activity of these enzymes, which in turn can affect both the intensity and duration of drug action, as well as drug metabolism and clearance.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic variants of a protein in which one or more of the protein functions in one population are different from those in another population. SNPs and the encoded variant peptides thus provide targets to ascertain a genetic predisposition that can affect treatment modality. For example, in a ligand-based treatment, SNPs may give rise to amino terminal extracellular domains and/or other ligand-binding regions of a receptor that are more or less active in ligand binding, thereby affecting subsequent protein activation. Accordingly, ligand dosage would necessarily be modified to maximize the therapeutic effect within a given population containing particular SNP alleles or haplotypes.

As an alternative to genotyping, specific variant proteins containing variant amino acid sequences encoded by alternative SNP alleles could be identified. Thus, pharmacogenomic characterization of an individual permits the selection of effective compounds and effective dosages of such compounds for prophylactic or therapeutic uses based on the individual's SNP genotype, thereby enhancing and optimizing the effectiveness of the therapy. Furthermore, the production of recombinant cells and transgenic animals containing particular SNPs/haplotypes allow effective clinical design and testing of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in treating psoriasis. Pharmacogenomic characterization of an individual, based on an individual's SNP genotype, can identify those individuals unlikely to respond to treatment with a particular medication and thereby allows physicians to avoid prescribing the ineffective medication to those individuals. On the other hand, SNP genotyping of an individual may enable physicians to select the appropriate medication and dosage regimen that will be most effective based on an individual's SNP genotype. This information increases a physician's confidence in prescribing medications and motivates patients to comply with their drug regimens. Furthermore, pharmacogenomics may identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et. al., Trends in Biotechnology, August 2000.). Thus, pharmacogenomics based on the SNPs disclosed herein has the potential to both save lives and reduce healthcare costs substantially.

Attempts have been made to develop drugs that can be used to treat psoriasis. Several drug candidates have been introduced into clinical trials to test their efficacy in treating psoriasis. Among them are ABT-874, STA-5326, and CNTO-1275. For references discussing these drugs, please see Burakoff, et al., A phase 1/2A trial of STA 5326, an oral interleukin-12/23 inhibitor, in patients with active moderate to severe Crohn's disease. Inflamm Bowel Dis. 2006 July; 12(7):558-65, and Borchardt J K, Focus on small molecule inhibitors for treatment of inflammatory and autoimmune diseases. Drug News Perspect. 2004 November; 17(9):607-14 (for STA-5326); Sandborn W J, How future tumor necrosis factor antagonists and other compounds will meet the remaining challenges in Crohn's disease. Rev Gastroenterol Disord. 2004; 4 Suppl 3:S25-33 (for ABT-874); Papp K A. Potential future therapies for psoriasis. Semin Cutan Med Surg. 2005 March; 24(1):58-63 (for CNTO-1275). These drug candidates target the metabolic pathway involving IL-12 and IL-23 genes.

It is also well known in the art that markers that are diagnostically useful in distinguishing patients at higher risk of developing a disease, such as psoriasis from those who are at a decreased risk of developing psoriasis can be useful in identifying those patients that are more likely to respond to drug treatments targeting at those pathways involving genes where the diagnostic SNPs reside. See references Gerdes, et al., Circulation, 2000; 101:1366-1371, Kuivenhoven, et al., N Engl J Med 1998; 338:86-93, Stolarz, et al., Hypertension 2004; 44:156-162, Chartier-Harlin, et al., Hum. Mol. Genet. 1994 April; 3(4):569-74, Roses, et al., The Pharmacogenomics Journal 2006, 1-19.

In that regard, embodiments of the present invention can be very useful in assisting clinicians select patients who are more likely to develop psoriasis, and are in turn good candidates for drug responses targeting psoriasis, thus warrant the application of the above-metioned drug treatments on such patients. In the mean time, patients who are deemed to have low risk of developing psoriasis, using SNP markers discovered herein, can be spared of the aggravation and wastfulness of the drug due to the reduced benefit of such treatment in view of its cost and side effect.

Pharmacogenomics in general is discussed further in Rose et al., "Pharmacogenetic analysis of clinically relevant genetic polymorphisms", *Methods Mol Med.* 2003; 85:225-37. Pharmacogenomics as it relates to Alzheimer's disease and other neurodegenerative disorders is discussed in Cacabelos, "Pharmacogenomics for the treatment of dementia", *Ann Med.* 2002; 34(5):357-79, Maimone et al., "Pharmacogenomics of neurodegenerative diseases", *Eur J Pharmacol.* 2001 Feb. 9; 413(1):11-29, and Poirier, "Apolipoprotein E: a pharmacogenetic target for the treatment of Alzheimer's disease", *Mol Diagn.* 1999 December; 4(4):335-41. Pharmacogenomics as it relates to cardiovascular disorders is discussed in Siest et al., "Pharmacogenomics of drugs affecting the cardiovascular system", *Clin Chem Lab Med.* 2003 April; 41(4):590-9, Mukherjee et al., "Pharmacogenomics in cardiovascular diseases", *Prog Cardiovasc Dis.* 2002 May-June; 44(6):479-98, and Mooser et al., "Cardiovascular pharmacogenetics in the SNP era", *J Thromb Haemost.* 2003 July; 1(7): 1398-402. Pharmacogenomics as it relates to cancer is discussed in McLeod et al., "Cancer pharmacogenomics: SNPs, chips, and the individual patient", *Cancer Invest.* 2003; 21(4): 630-40 and Watters et al., "Cancer pharmacogenomics: current and future applications", *Biochim Biophys Acta.* 2003 Mar. 17; 1603(2):99-111.

The SNPs of the present invention also can be used to identify novel therapeutic targets for psoriasis. For example, genes containing the disease-associated variants ("variant genes") or their products, as well as genes or their products that are directly or indirectly regulated by or interacting with these variant genes or their products, can be targeted for the development of therapeutics that, for example, treat the disease or prevent or delay disease onset. The therapeutics may be composed of, for example, small molecules, proteins, protein fragments or peptides, antibodies, nucleic acids, or their derivatives or mimetics which modulate the functions or levels of the target genes or gene products.

The SNP-containing nucleic acid molecules disclosed herein, and their complementary nucleic acid molecules, may be used as antisense constructs to control gene expression in cells, tissues, and organisms. Antisense technology is well established in the art and extensively reviewed in *Antisense Drug Technology: Principles, Strategies, and Applications*, Crooke (ed.), Marcel Dekker, Inc.: New York (2001). An antisense nucleic acid molecule is generally designed to be complementary to a region of mRNA expressed by a gene so that the antisense molecule hybridizes to the mRNA and thereby blocks translation of mRNA into protein. Various classes of antisense oligonucleotides are used in the art, two of which are cleavers and blockers. Cleavers, by binding to target RNAs, activate intracellular nucleases (e.g., RNaseH or RNase L) that cleave the target RNA. Blockers, which also bind to target RNAs, inhibit protein translation through steric hindrance of ribosomes. Exemplary blockers include peptide nucleic acids, morpholinos, locked nucleic acids, and methylphosphonates (see, e.g., Thompson, *Drug Discovery Today*, 7 (17): 912-917 (2002)). Antisense oligonucleotides are directly useful as therapeutic agents, and are also useful for determining and validating gene function (e.g., in gene knock-out or knock-down experiments).

Antisense technology is further reviewed in: Layery et al., "Antisense and RNAi: powerful tools in drug target discovery and validation", *Curr Opin Drug Discov Devel.* 2003 July; 6(4):561-9; Stephens et al., "Antisense oligonucleotide therapy in cancer", *Curr Opin Mol. Ther.* 2003 April; 5(2): 118-22; Kurreck, "Antisense technologies. Improvement through novel chemical modifications", *Eur J Biochem.* 2003 April; 270(8):1628-44; Dias et al., "Antisense oligonucleotides: basic concepts and mechanisms", *Mol Cancer Ther.* 2002 March; 1(5):347-55; Chen, "Clinical development of antisense oligonucleotides as anti-cancer therapeutics", *Methods Mol Med.* 2003; 75:621-36; Wang et al., "Antisense anticancer oligonucleotide therapeutics", *Curr Cancer Drug Targets.* 2001 November; 1(3):177-96; and Bennett, "Efficiency of antisense oligonucleotide drug discovery", *Antisense Nucleic Acid Drug Dev.* 2002 June; 12(3):215-24.

The SNPs of the present invention are particularly useful for designing antisense reagents that are specific for particular nucleic acid variants. Based on the SNP information disclosed herein, antisense oligonucleotides can be produced that specifically target mRNA molecules that contain one or more particular SNP nucleotides. In this manner, expression of mRNA molecules that contain one or more undesired polymorphisms (e.g., SNP nucleotides that lead to a defective protein such as an amino acid substitution in a catalytic domain) can be inhibited or completely blocked. Thus, antisense oligonucleotides can be used to specifically bind a particular polymorphic form (e.g., a SNP allele that encodes a defective protein), thereby inhibiting translation of this form, but which do not bind an alternative polymorphic form (e.g., an alternative SNP nucleotide that encodes a protein having normal function).

Antisense molecules can be used to inactivate mRNA in order to inhibit gene expression and production of defective proteins. Accordingly, these molecules can be used to treat a disorder, such as psoriasis, characterized by abnormal or undesired gene expression or expression of certain defective proteins. This technique can involve cleavage by means of ribozymes containing nucleotide sequences complementary to one or more regions in the mRNA that attenuate the ability of the mRNA to be translated. Possible mRNA regions include, for example, protein-coding regions and particularly protein-coding regions corresponding to catalytic activities, substrate/ligand binding, or other functional activities of a protein.

The SNPs of the present invention are also useful for designing RNA interference reagents that specifically target nucleic acid molecules having particular SNP variants. RNA interference (RNAi), also referred to as gene silencing, is based on using double-stranded RNA (dsRNA) molecules to turn genes off. When introduced into a cell, dsRNAs are processed by the cell into short fragments (generally about 21, 22, or 23 nucleotides in length) known as small interfering RNAs (siRNAs) which the cell uses in a sequence-specific manner to recognize and destroy complementary RNAs (Thompson, *Drug Discovery Today*, 7 (17): 912-917 (2002)). Accordingly, an aspect of the present invention specifically contemplates isolated nucleic acid molecules that are about 18-26 nucleotides in length, preferably 19-25 nucleotides in length, and more preferably 20, 21, 22, or 23 nucleotides in length, and the use of these nucleic acid molecules for RNAi. Because RNAi molecules, including siRNAs, act in a sequence-specific manner, the SNPs of the present invention can be used to design RNAi reagents that recognize and destroy nucleic acid molecules having specific SNP alleles/nucleotides (such as deleterious alleles that lead to the production of defective proteins), while not affecting nucleic acid molecules having alternative SNP alleles (such as alleles that encode proteins having normal function). As with antisense reagents, RNAi reagents may be directly useful as therapeutic agents (e.g., for turning off defective, disease-causing genes), and are also useful for characterizing and validating gene function (e.g., in gene knock-out or knock-down experiments).

The following references provide a further review of RNAi: Reynolds et al., "Rational siRNA design for RNA interference", *Nat Biotechnol*. 2004 March; 22(3):326-30. Epub 2004 Feb. 1; Chi et al., "Genomewide view of gene silencing by small interfering RNAs", *PNAS* 100(11):6343-6346, 2003; Vickers et al., "Efficient Reduction of Target RNAs by Small Interfering RNA and RNase H-dependent Antisense Agents", *J. Biol. Chem.* 278: 7108-7118, 2003; Agami, "RNAi and related mechanisms and their potential use for therapy", *Curr Opin Chem Biol*. 2002 December; 6(6):829-34; Layery et al., "Antisense and RNAi: powerful tools in drug target discovery and validation", *Curr Opin Drug Discov Devel*. 2003 July; 6(4):561-9; Shi, "Mammalian RNAi for the masses", *Trends Genet*. 2003 January; 19(1):9-12), Shuey et al., "RNAi: gene-silencing in therapeutic intervention", *Drug Discovery Today* 2002 October; 7(20): 1040-1046; McManus et al., *Nat Rev Genet*. 2002 October; 3(10): 737-47; Xia et al., *Nat Biotechnol* 2002 October; 20(10): 1006-10; Plasterk et al., *Curr Opin Genet Dev* 2000 October; 10(5):562-7; Bosher et al., *Nat Cell Biol* 2000 February; 2(2):E31-6; and Hunter, *Curr Biol* 1999 Jun. 17; 9(12):R440-2).

A subject suffering from a pathological condition, such as psoriasis, ascribed to a SNP may be treated so as to correct the genetic defect (see Kren et al., *Proc. Natl. Acad. Sci. USA* 96:10349-10354 (1999)). Such a subject can be identified by any method that can detect the polymorphism in a biological sample drawn from the subject. Such a genetic defect may be permanently corrected by administering to such a subject a nucleic acid fragment incorporating a repair sequence that supplies the normal/wild-type nucleotide at the position of the SNP. This site-specific repair sequence can encompass an RNA/DNA oligonucleotide that operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induce incorporation of the normal sequence into the subject's genome. Upon incorporation, the normal gene product is expressed, and the replacement is propagated, thereby engendering a permanent repair and therapeutic enhancement of the clinical condition of the subject.

In cases in which a cSNP results in a variant protein that is ascribed to be the cause of, or a contributing factor to, a pathological condition, a method of treating such a condition can include administering to a subject experiencing the pathology the wild-type/normal cognate of the variant protein. Once administered in an effective dosing regimen, the wild-type cognate provides complementation or remediation of the pathological condition.

The invention further provides a method for identifying a compound or agent that can be used to treat psoriasis. The SNPs disclosed herein are useful as targets for the identification and/or development of therapeutic agents. A method for identifying a therapeutic agent or compound typically includes assaying the ability of the agent or compound to modulate the activity and/or expression of a SNP-containing nucleic acid or the encoded product and thus identifying an agent or a compound that can be used to treat a disorder characterized by undesired activity or expression of the SNP-containing nucleic acid or the encoded product. The assays can be performed in cell-based and cell-free systems. Cell-based assays can include cells naturally expressing the nucleic acid molecules of interest or recombinant cells genetically engineered to express certain nucleic acid molecules.

Variant gene expression in a psoriasis patient can include, for example, either expression of a SNP-containing nucleic acid sequence (for instance, a gene that contains a SNP can be transcribed into an mRNA transcript molecule containing the SNP, which can in turn be translated into a variant protein) or altered expression of a normal/wild-type nucleic acid sequence due to one or more SNPs (for instance, a regulatory/control region can contain a SNP that affects the level or pattern of expression of a normal transcript).

Assays for variant gene expression can involve direct assays of nucleic acid levels (e.g., mRNA levels), expressed protein levels, or of collateral compounds involved in a signal pathway. Further, the expression of genes that are up- or down-regulated in response to the signal pathway can also be assayed. In this embodiment, the regulatory regions of these genes can be operably linked to a reporter gene such as luciferase.

Modulators of variant gene expression can be identified in a method wherein, for example, a cell is contacted with a candidate compound/agent and the expression of mRNA determined. The level of expression of mRNA in the presence of the candidate compound is compared to the level of expression of mRNA in the absence of the candidate compound. The candidate compound can then be identified as a modulator of variant gene expression based on this comparison and be used to treat a disorder such as psoriasis that is characterized by variant gene expression (e.g., either expression of a SNP-containing nucleic acid or altered expression of a normal/wild-type nucleic acid molecule due to one or more SNPs that affect expression of the nucleic acid molecule) due to one or more SNPs of the present invention. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP or associated nucleic acid domain (e.g., catalytic domain, ligand/substrate-binding domain, regulatory/control region, etc.) or gene, or the encoded mRNA transcript, as a target, using a compound identified through drug screening as a gene modulator to modulate variant nucleic acid expression. Modulation can include either up-regulation (i.e., activation or agonization) or down-regulation (i.e., suppression or antagonization) of nucleic acid expression.

Expression of mRNA transcripts and encoded proteins, either wild type or variant, may be altered in individuals with a particular SNP allele in a regulatory/control element, such as a promoter or transcription factor binding domain, that regulates expression. In this situation, methods of treatment and compounds can be identified, as discussed herein, that regulate or overcome the variant regulatory/control element, thereby generating normal, or healthy, expression levels of either the wild type or variant protein.

The SNP-containing nucleic acid molecules of the present invention are also useful for monitoring the effectiveness of modulating compounds on the expression or activity of a variant gene, or encoded product, in clinical trials or in a treatment regimen. Thus, the gene expression pattern can serve as an indicator for the continuing effectiveness of treatment with the compound, particularly with compounds to which a patient can develop resistance, as well as an indicator for toxicities. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

In another aspect of the present invention, there is provided a pharmaceutical pack comprising a therapeutic agent (e.g., a small molecule drug, antibody, peptide, antisense or RNAi nucleic acid molecule, etc.) and a set of instructions for administration of the therapeutic agent to humans diagnostically tested for one or more SNPs or SNP haplotypes provided by the present invention.

The SNPs/haplotypes of the present invention are also useful for improving many different aspects of the drug development process. For instance, an aspect of the present invention includes selecting individuals for clinical trials based on their SNP genotype. For example, individuals with SNP genotypes that indicate that they are likely to positively respond to a drug can be included in the trials, whereas those individuals whose SNP genotypes indicate that they are less likely to or would not respond to the drug, or who are at risk for suffering toxic effects or other adverse reactions, can be excluded from the clinical trials. This not only can improve the safety of clinical trials, but also can enhance the chances that the trial will demonstrate statistically significant efficacy. Furthermore, the SNPs of the present invention may explain why certain previously developed drugs performed poorly in clinical trials and may help identify a subset of the population that would benefit from a drug that had previously performed poorly in clinical trials, thereby "rescuing" previously developed drugs, and enabling the drug to be made available to a particular psoriasis patient population that can benefit from it.

SNPs have many important uses in drug discovery, screening, and development. A high probability exists that, for any gene/protein selected as a potential drug target, variants of that gene/protein will exist in a patient population. Thus, determining the impact of gene/protein variants on the selection and delivery of a therapeutic agent should be an integral aspect of the drug discovery and development process. (Jazwinska, *A Trends Guide to Genetic Variation and Genomic Medicine*, 2002 March; S30-S36).

Knowledge of variants (e.g., SNPs and any corresponding amino acid polymorphisms) of a particular therapeutic target (e.g., a gene, mRNA transcript, or protein) enables parallel screening of the variants in order to identify therapeutic candidates (e.g., small molecule compounds, antibodies, antisense or RNAi nucleic acid compounds, etc.) that demonstrate efficacy across variants (Rothberg, *Nat Biotechnol* 2001 March; 19(3):209-11). Such therapeutic candidates would be expected to show equal efficacy across a larger segment of the patient population, thereby leading to a larger potential market for the therapeutic candidate.

Furthermore, identifying variants of a potential therapeutic target enables the most common form of the target to be used for selection of therapeutic candidates, thereby helping to ensure that the experimental activity that is observed for the selected candidates reflects the real activity expected in the largest proportion of a patient population (Jazwinska, *A Trends Guide to Genetic Variation and Genomic Medicine*, 2002 March; S30-S36).

Additionally, screening therapeutic candidates against all known variants of a target can enable the early identification of potential toxicities and adverse reactions relating to particular variants. For example, variability in drug absorption, distribution, metabolism and excretion (ADME) caused by, for example, SNPs in therapeutic targets or drug metabolizing genes, can be identified, and this information can be utilized during the drug development process to minimize variability in drug disposition and develop therapeutic agents that are safer across a wider range of a patient population. The SNPs of the present invention, including the variant proteins and encoding polymorphic nucleic acid molecules provided in Tables 1-2, are useful in conjunction with a variety of toxicology methods established in the art, such as those set forth in *Current Protocols in Toxicology*, John Wiley & Sons, Inc., N.Y.

Furthermore, therapeutic agents that target any art-known proteins (or nucleic acid molecules, either RNA or DNA) may cross-react with the variant proteins (or polymorphic nucleic acid molecules) disclosed in Table 1, thereby significantly affecting the pharmacokinetic properties of the drug. Consequently, the protein variants and the SNP-containing nucleic acid molecules disclosed in Tables 1-2 are useful in developing, screening, and evaluating therapeutic agents that target corresponding art-known protein forms (or nucleic acid molecules). Additionally, as discussed above, knowledge of all polymorphic forms of a particular drug target enables the design of therapeutic agents that are effective against most or all such polymorphic forms of the drug target.

Pharmaceutical Compositions and Administration Thereof

Any of the psoriasis-associated proteins, and encoding nucleic acid molecules, disclosed herein can be used as therapeutic targets (or directly used themselves as therapeutic compounds) for treating psoriasis and related pathologies, and the present disclosure enables therapeutic compounds (e.g., small molecules, antibodies, therapeutic proteins, RNAi and antisense molecules, etc.) to be developed that target (or are comprised of) any of these therapeutic targets.

In general, a therapeutic compound will be administered in a therapeutically effective amount by any of the accepted modes of administration for agents that serve similar utilities. The actual amount of the therapeutic compound of this invention, i.e., the active ingredient, will depend upon numerous factors such as the severity of the disease to be treated, the age and relative health of the subject, the potency of the compound used, the route and form of administration, and other factors.

Therapeutically effective amounts of therapeutic compounds may range from, for example, approximately 0.01-50 mg per kilogram body weight of the recipient per day; preferably about 0.1-20 mg/kg/day. Thus, as an example, for administration to a 70 kg person, the dosage range would most preferably be about 7 mg to 1.4 g per day.

In general, therapeutic compounds will be administered as pharmaceutical compositions by any one of the following routes: oral, systemic (e.g., transdermal, intranasal, or by suppository), or parenteral (e.g., intramuscular, intravenous, or subcutaneous) administration. The preferred manner of administration is oral or parenteral using a convenient daily dosage regimen, which can be adjusted according to the degree of affliction. Oral compositions can take the form of tablets, pills, capsules, semisolids, powders, sustained release formulations, solutions, suspensions, elixirs, aerosols, or any other appropriate compositions.

The choice of formulation depends on various factors such as the mode of drug administration (e.g., for oral administration, formulations in the form of tablets, pills, or capsules are preferred) and the bioavailability of the drug substance. Recently, pharmaceutical formulations have been developed especially for drugs that show poor bioavailability based upon the principle that bioavailability can be increased by increasing the surface area, i.e., decreasing particle size. For example, U.S. Pat. No. 4,107,288 describes a pharmaceutical formulation having particles in the size range from 10 to 1,000 nm in which the active material is supported on a cross-linked matrix of macromolecules. U.S. Pat. No. 5,145,684 describes the production of a pharmaceutical formulation in which the drug substance is pulverized to nanoparticles (average particle size of 400 mm) in the presence of a surface modifier and then dispersed in a liquid medium to give a pharmaceutical formulation that exhibits remarkably high bioavailability.

Pharmaceutical compositions are comprised of, in general, a therapeutic compound in combination with at least one pharmaceutically acceptable excipient. Acceptable excipients are non-toxic, aid administration, and do not adversely affect the therapeutic benefit of the therapeutic compound. Such excipients may be any solid, liquid, semi-solid or, in the case of an aerosol composition, gaseous excipient that is generally available to one skilled in the art.

Solid pharmaceutical excipients include starch, cellulose, talc, glucose, lactose, sucrose, gelatin, malt, rice, flour, chalk, silica gel, magnesium stearate, sodium stearate, glycerol monostearate, sodium chloride, dried skim milk and the like. Liquid and semisolid excipients may be selected from glycerol, propylene glycol, water, ethanol and various oils, including those of petroleum, animal, vegetable or synthetic origin, e.g., peanut oil, soybean oil, mineral oil, sesame oil, etc. Preferred liquid carriers, particularly for injectable solutions, include water, saline, aqueous dextrose, and glycols.

Compressed gases may be used to disperse a compound of this invention in aerosol form. Inert gases suitable for this purpose are nitrogen, carbon dioxide, etc.

Other suitable pharmaceutical excipients and their formulations are described in Remington's Pharmaceutical Sciences, edited by E. W. Martin (Mack Publishing Company, 18$^{th}$ ed., 1990).

The amount of the therapeutic compound in a formulation can vary within the full range employed by those skilled in the art. Typically, the formulation will contain, on a weight percent (wt %) basis, from about 0.01-99.99 wt % of the therapeutic compound based on the total formulation, with the balance being one or more suitable pharmaceutical excipients. Preferably, the compound is present at a level of about 1-80 wt %.

Therapeutic compounds can be administered alone or in combination with other therapeutic compounds or in combination with one or more other active ingredient(s). For example, an inhibitor or stimulator of a psoriasis-associated protein can be administered in combination with another agent that inhibits or stimulates the activity of the same or a different psoriasis-associated protein to thereby counteract the affects of psoriasis.

For further information regarding pharmacology, see *Current Protocols in Pharmacology*, John Wiley & Sons, Inc., N.Y.

Human Identification Applications

In addition to their diagnostic and therapeutic uses in psoriasis and related pathologies, the SNPs provided by the present invention are also useful as human identification markers for such applications as forensics, paternity testing, and biometrics (see, e.g., Gill, "An assessment of the utility of single nucleotide polymorphisms (SNPs) for forensic purposes", *Int J Legal Med*. 2001; 114(4-5):204-10). Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked (i.e., inherited independently). Thus, preferred sets of SNPs can be selected from among the SNPs disclosed herein, which may include SNPs on different chromosomes, SNPs on different chromosome arms, and/or SNPs that are dispersed over substantial distances along the same chromosome arm.

Furthermore, among the SNPs disclosed herein, preferred SNPs for use in certain forensic/human identification applications include SNPs located at degenerate codon positions (i.e., the third position in certain codons which can be one of two or more alternative nucleotides and still encode the same amino acid), since these SNPs do not affect the encoded protein. SNPs that do not affect the encoded protein are expected to be under less selective pressure and are therefore expected to be more polymorphic in a population, which is typically an advantage for forensic/human identification applications. However, for certain forensics/human identification applications, such as predicting phenotypic characteristics (e.g., inferring ancestry or inferring one or more physical characteristics of an individual) from a DNA sample, it may be desirable to utilize SNPs that affect the encoded protein.

For many of the SNPs disclosed in Tables 1-2 (which are identified as "Applera" SNP source), Tables 1-2 provide SNP allele frequencies obtained by re-sequencing the DNA of chromosomes from 39 individuals (Tables 1-2 also provide allele frequency information for "Celera" source SNPs and, where available, public SNPs from dbEST, HGBASE, and/or HGMD). The allele frequencies provided in Tables 1-2 enable these SNPs to be readily used for human identification applications. Although any SNP disclosed in Table 1 and/or Table 2 could be used for human identification, the closer that the frequency of the minor allele at a particular SNP site is to 50%, the greater the ability of that SNP to discriminate between different individuals in a population since it becomes increasingly likely that two randomly selected individuals would have different alleles at that SNP site. Using the SNP allele frequencies provided in Tables 1-2, one of ordinary skill in the art could readily select a subset of SNPs for which the frequency of the minor allele is, for example, at least 1%, 2%, 5%, 10%, 20%, 25%, 30%, 40%, 45%, or 50%, or any other frequency in-between. Thus, since Tables 1-2 provide allele frequencies based on the re-sequencing of the chromosomes from 39 individuals, a subset of SNPs could readily be selected for human identification in which the total allele count of the minor allele at a particular SNP site is, for example, at least 1, 2, 4, 8, 10, 16, 20, 24, 30, 32, 36, 38, 39, 40, or any other number in-between.

Furthermore, Tables 1-2 also provide population group (interchangeably referred to herein as ethnic or racial groups) information coupled with the extensive allele frequency information. For example, the group of 39 individuals whose DNA was re-sequenced was made-up of 20 Caucasians and 19 African-Americans. This population group information enables further refinement of SNP selection for human identification. For example, preferred SNPs for human identification can be selected from Tables 1-2 that have similar allele frequencies in both the Caucasian and African-American populations; thus, for example, SNPs can be selected that have equally high discriminatory power in both populations. Alternatively, SNPs can be selected for which there is a statistically significant difference in allele frequencies between the Caucasian and African-American populations (as an extreme example, a particular allele may be observed only in either the Caucasian or the African-American population group but not observed in the other population group); such SNPs are useful, for example, for predicting the race/ethnicity of an unknown perpetrator from a biological sample such as a hair or blood stain recovered at a crime scene. For a discussion of using SNPs to predict ancestry from a DNA sample, including statistical methods, see Frudakis et al., "A Classifier for the SNP-Based Inference of Ancestry", *Journal of Forensic Sciences* 2003; 48(4):771-782.

SNPs have numerous advantages over other types of polymorphic markers, such as short tandem repeats (STRs). For example, SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationaly more stable than repeat polymorphisms. SNPs are not susceptible to artefacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Another significant advantage of SNP markers over STR markers is the much shorter length of nucleic acid needed to score a SNP. For example, STR markers are generally several hundred base pairs in length. A SNP, on the other hand, comprises a single nucleotide, and generally a short conserved region on either side of the SNP position for primer and/or probe binding. This makes SNPs more amenable to typing in highly degraded or aged biological samples that are frequently encountered in forensic casework in which DNA may be fragmented into short pieces.

SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units than has been previously seen in the population, or more or less repeat alleles than are included in a reference allelic ladder. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis.

SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, and therefore the statistical significance of a matching genotype may be questionable. All these advantages of SNP analysis are considerable in light of the consequences of most DNA identification cases, which may lead to life imprisonment for an individual, or re-association of remains to the family of a deceased individual.

DNA can be isolated from biological samples such as blood, bone, hair, saliva, or semen, and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs known in the art or STRs, in order to identify an individual or to associate an individual with a particular biological sample.

Furthermore, the SNPs provided by the present invention can be genotyped for inclusion in a database of DNA genotypes, for example, a criminal DNA databank such as the FBI's Combined DNA Index System (CODIS) database. A genotype obtained from a biological sample of unknown source can then be queried against the database to find a matching genotype, with the SNPs of the present invention providing nucleotide positions at which to compare the known and unknown DNA sequences for identity. Accordingly, the present invention provides a database comprising novel SNPs or SNP alleles of the present invention (e.g., the database can comprise information indicating which alleles are possessed by individual members of a population at one or more novel SNP sites of the present invention), such as for use in forensics, biometrics, or other human identification applications. Such a database typically comprises a computer-based system in which the SNPs or SNP alleles of the present invention are recorded on a computer readable medium (see the section of the present specification entitled "Computer-Related Embodiments").

The SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child, with the SNPs of the present invention providing nucleotide positions at which to compare the putative father's and child's DNA sequences for identity. If the set of polymorphisms in the child attributable to the father does not match the set of polymorphisms of the putative father, it can be concluded, barring experimental error, that the putative father is not the father of the child. If the set of polymorphisms in the child attributable to the father match the set of polymorphisms of the putative father, a statistical calculation can be performed to determine the probability of coincidental match, and a conclusion drawn as to the likelihood that the putative father is the true biological father of the child.

In addition to paternity testing, SNPs are also useful for other types of kinship testing, such as for verifying familial relationships for immigration purposes, or for cases in which an individual alleges to be related to a deceased individual in order to claim an inheritance from the deceased individual, etc. For further information regarding the utility of SNPs for paternity testing and other types of kinship testing, including methods for statistical analysis, see Krawczak, "Informativity assessment for biallelic single nucleotide polymorphisms", *Electrophoresis* 1999 June; 20(8):1676-81.

The use of the SNPs of the present invention for human identification further extends to various authentication systems, commonly referred to as biometric systems, which typically convert physical characteristics of humans (or other organisms) into digital data. Biometric systems include various technological devices that measure such unique anatomical or physiological characteristics as finger, thumb, or palm prints; hand geometry; vein patterning on the back of the hand; blood vessel patterning of the retina and color and texture of the iris; facial characteristics; voice patterns; signature and typing dynamics; and DNA. Such physiological measurements can be used to verify identity and, for example, restrict or allow access based on the identification. Examples of applications for biometrics include physical area security, computer and network security, aircraft passenger check-in and boarding, financial transactions, medical records access, government benefit distribution, voting, law enforcement, passports, visas and immigration, prisons, various military applications, and for restricting access to expensive or dangerous items, such as automobiles or guns (see, for example, O'Connor, *Stanford Technology Law Review* and U.S. Pat. No. 6,119,096).

Groups of SNPs, particularly the SNPs provided by the present invention, can be typed to uniquely identify an individual for biometric applications such as those described above. Such SNP typing can readily be accomplished using, for example, DNA chips/arrays. Preferably, a minimally invasive means for obtaining a DNA sample is utilized. For example, PCR amplification enables sufficient quantities of DNA for analysis to be obtained from buccal swabs or fingerprints, which contain DNA-containing skin cells and oils that are naturally transferred during contact. Further information regarding techniques for using SNPs in forensic/human identification applications can be found in, for example, *Current Protocols in Human Genetics*, John Wiley & Sons, N.Y. (2002), 14.1-14.7.

Variant Proteins, Antibodies, Vectors & Host Cells, & uses Thereof

Variant Proteins Encoded by SNP-Containing Nucleic Acid Molecules

The present invention provides SNP-containing nucleic acid molecules, many of which encode proteins having variant amino acid sequences as compared to the art-known (i.e., wild-type) proteins. Amino acid sequences encoded by the polymorphic nucleic acid molecules of the present invention are provided as SEQ ID NOS:4-6 in Table 1 and the Sequence Listing. These variants will generally be referred to herein as variant proteins/peptides/polypeptides, or polymorphic proteins/peptides/polypeptides of the present invention. The terms "protein", "peptide", and "polypeptide" are used herein interchangeably.

A variant protein of the present invention may be encoded by, for example, a nonsynonymous nucleotide substitution at any one of the cSNP positions disclosed herein. In addition, variant proteins may also include proteins whose expression, structure, and/or function is altered by a SNP disclosed herein, such as a SNP that creates or destroys a stop codon, a SNP that affects splicing, and a SNP in control/regulatory elements, e.g. promoters, enhancers, or transcription factor binding domains.

As used herein, a protein or peptide is said to be "isolated" or "purified" when it is substantially free of cellular material or chemical precursors or other chemicals. The variant proteins of the present invention can be purified to homogeneity or other lower degrees of purity. The level of purification will be based on the intended use. The key feature is that the preparation allows for the desired function of the variant protein, even if in the presence of considerable amounts of other components.

As used herein, "substantially free of cellular material" includes preparations of the variant protein having less than about 30% (by dry weight) other proteins (i.e., contaminating protein), less than about 20% other proteins, less than about 10% other proteins, or less than about 5% other proteins. When the variant protein is recombinantly produced, it can also be substantially free of culture medium, i.e., culture medium represents less than about 20% of the volume of the protein preparation.

The language "substantially free of chemical precursors or other chemicals" includes preparations of the variant protein in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

An isolated variant protein may be purified from cells that naturally express it, purified from cells that have been altered to express it (recombinant host cells), or synthesized using known protein synthesis methods. For example, a nucleic acid molecule containing SNP(s) encoding the variant protein can be cloned into an expression vector, the expression vector introduced into a host cell, and the variant protein expressed in the host cell. The variant protein can then be isolated from the cells by any appropriate purification scheme using standard protein purification techniques. Examples of these techniques are described in detail below (Sambrook and Russell, 2000, Molecular Cloning: A Laboratory Manual, Cold Spring Harbor Laboratory Press, Cold Spring Harbor, N.Y.).

The present invention provides isolated variant proteins that comprise, consist of or consist essentially of amino acid sequences that contain one or more variant amino acids encoded by one or more codons which contain a SNP of the present invention.

Accordingly, the present invention provides variant proteins that consist of amino acid sequences that contain one or more amino acid polymorphisms (or truncations or extensions due to creation or destruction of a stop codon, respectively) encoded by the SNPs provided in Table 1 and/or Table 2. A protein consists of an amino acid sequence when the amino acid sequence is the entire amino acid sequence of the protein.

The present invention further provides variant proteins that consist essentially of amino acid sequences that contain one or more amino acid polymorphisms (or truncations or extensions due to creation or destruction of a stop codon, respectively) encoded by the SNPs provided in Table 1 and/or Table 2. A protein consists essentially of an amino acid sequence when such an amino acid sequence is present with only a few additional amino acid residues in the final protein.

The present invention further provides variant proteins that comprise amino acid sequences that contain one or more amino acid polymorphisms (or truncations or extensions due to creation or destruction of a stop codon, respectively) encoded by the SNPs provided in Table 1 and/or Table 2. A protein comprises an amino acid sequence when the amino acid sequence is at least part of the final amino acid sequence of the protein. In such a fashion, the protein may contain only the variant amino acid sequence or have additional amino acid residues, such as a contiguous encoded sequence that is naturally associated with it or heterologous amino acid residues. Such a protein can have a few additional amino acid residues or can comprise many more additional amino acids. A brief description of how various types of these proteins can be made and isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the coding sequences for the variant protein and the heterologous protein are ligated in-frame. The heterologous protein can be fused to the N-terminus or C-terminus of the variant protein. In another embodiment, the fusion protein is encoded by a fusion polynucleotide that is synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., *Current Protocols in Molecular Biology*, 1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

In many uses, the fusion protein does not affect the activity of the variant protein. The fusion protein can include, but is not limited to, enzymatic fusion proteins, for example, beta-galactosidase fusions, yeast two-hybrid GAL fusions, poly-His fusions, MYC-tagged, HI-tagged and Ig fusions. Such fusion proteins, particularly poly-His fusions, can facilitate their purification following recombinant expression. In certain host cells (e.g., mammalian host cells), expression and/or secretion of a protein can be increased by using a heterologous signal sequence. Fusion proteins are further described in, for example, Terpe, "Overview of tag protein fusions: from molecular and biochemical fundamentals to commercial systems", *Appl Microbiol Biotechnol.* 2003 January; 60(5):523-33. Epub 2002 November 07; Graddis et al., "Designing proteins that work using recombinant technologies", *Curr Pharm Biotechnol.* 2002 December; 3(4):285-97; and Nilsson et al., "Affinity fusion strategies for detection, purification, and immobilization of recombinant proteins", *Protein Expr Purif.* 1997 October; 11(1): 1-16.

The present invention also relates to further obvious variants of the variant polypeptides of the present invention, such as naturally-occurring mature forms (e.g., alleleic variants), non-naturally occurring recombinantly-derived variants, and orthologs and paralogs of such proteins that share sequence homology. Such variants can readily be generated using art-known techniques in the fields of recombinant nucleic acid technology and protein biochemistry. It is understood, however, that variants exclude those known in the prior art before the present invention.

Further variants of the variant polypeptides disclosed in Table 1 can comprise an amino acid sequence that shares at least 70-80%, 80-85%, 85-90%, 91%, 92%, 93%, 94%, 95%, 96%, 97%, 98%, or 99% sequence identity with an amino acid sequence disclosed in Table 1 (or a fragment thereof) and that includes a novel amino acid residue (allele) disclosed in Table 1 (which is encoded by a novel SNP allele). Thus, an aspect of the present invention that is specifically contemplated are polypeptides that have a certain degree of sequence variation compared with the polypeptide sequences shown in Table 1, but that contain a novel amino acid residue (allele) encoded by a novel SNP allele disclosed herein. In other words, as long as a polypeptide contains a novel amino acid residue disclosed herein, other portions of the polypeptide that flank the novel amino acid residue can vary to some degree from the polypeptide sequences shown in Table 1.

Full-length pre-processed forms, as well as mature processed forms, of proteins that comprise one of the amino acid sequences disclosed herein can readily be identified as having complete sequence identity to one of the variant proteins of the present invention as well as being encoded by the same genetic locus as the variant proteins provided herein.

Orthologs of a variant peptide can readily be identified as having some degree of significant sequence homology/identity to at least a portion of a variant peptide as well as being encoded by a gene from another organism. Preferred orthologs will be isolated from non-human mammals, preferably primates, for the development of human therapeutic targets and agents. Such orthologs can be encoded by a nucleic acid sequence that hybridizes to a variant peptide-encoding nucleic acid molecule under moderate to stringent conditions depending on the degree of relatedness of the two organisms yielding the homologous proteins.

Variant proteins include, but are not limited to, proteins containing deletions, additions and substitutions in the amino acid sequence caused by the SNPs of the present invention. One class of substitutions is conserved amino acid substitutions in which a given amino acid in a polypeptide is substituted for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in, for example, Bowie et al., *Science* 247:1306-1310 (1990).

Variant proteins can be fully functional or can lack function in one or more activities, e.g. ability to bind another molecule, ability to catalyze a substrate, ability to mediate signaling, etc. Fully functional variants typically contain only conservative variations or variations in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, truncations or extensions, or a substitution, insertion, inversion, or deletion of a critical residue or in a critical region.

Amino acids that are essential for function of a protein can be identified by methods known in the art, such as site-directed mutagenesis or alanine-scanning mutagenesis (Cunningham et al., *Science* 244:1081-1085 (1989)), particularly using the amino acid sequence and polymorphism information provided in Table 1. The latter procedure introduces single alanine mutations at every residue in the molecule. The resulting mutant molecules are then tested for biological activity such as enzyme activity or in assays such as an in vitro proliferative activity. Sites that are critical for binding partner/substrate binding can also be determined by structural analysis such as crystallization, nuclear magnetic resonance or photoaffinity labeling (Smith et al., *J. Mol. Biol.* 224:899-904 (1992); de Vos et al. *Science* 255:306-312 (1992)).

Polypeptides can contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Accordingly, the variant proteins of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (e.g., polyethylene glycol), or in which additional amino acids are fused to the mature polypeptide, such as a leader or secretory sequence or a sequence for purification of the mature polypeptide or a pro-protein sequence.

Known protein modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such protein modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as *Proteins—Structure and Molecular Properties*, 2nd Ed., T. E. Creighton, W. H. Freeman and Company, New York (1993); Wold, F., *Posttranslational Covalent Modification of Proteins*, B. C. Johnson, Ed., Academic Press, New York 1-12 (1983); Seifter et al., *Meth. Enzymol.* 182: 626-646 (1990); and Rattan et al., *Ann. N.Y. Acad. Sci.* 663:48-62 (1992).

The present invention further provides fragments of the variant proteins in which the fragments contain one or more amino acid sequence variations (e.g., substitutions, or truncations or extensions due to creation or destruction of a stop codon) encoded by one or more SNPs disclosed herein. The fragments to which the invention pertains, however, are not to be construed as encompassing fragments that have been disclosed in the prior art before the present invention.

As used herein, a fragment may comprise at least about 4, 8, 10, 12, 14, 16, 18, 20, 25, 30, 50, 100 (or any other number in-between) or more contiguous amino acid residues from a variant protein, wherein at least one amino acid residue is affected by a SNP of the present invention, e.g., a variant amino acid residue encoded by a nonsynonymous nucleotide substitution at a cSNP position provided by the present invention. The variant amino acid encoded by a cSNP may occupy any residue position along the sequence of the fragment. Such fragments can be chosen based on the ability to retain one or more of the biological activities of the variant protein or the ability to perform a function, e.g., act as an immunogen. Particularly important fragments are biologically active fragments. Such fragments will typically comprise a domain or motif of a variant protein of the present invention, e.g., active site, transmembrane domain, or ligand/substrate binding domain. Other fragments include, but are not limited to, domain or motif-containing fragments, soluble peptide fragments, and fragments containing immunogenic structures. Predicted domains and functional sites are readily identifiable by computer programs well known to those of skill in the art (e.g., PROSITE analysis) (*Current Protocols in Protein Science*, John Wiley & Sons, N.Y. (2002)).

Uses of Variant Proteins

The variant proteins of the present invention can be used in a variety of ways, including but not limited to, in assays to determine the biological activity of a variant protein, such as in a panel of multiple proteins for high-throughput screening; to raise antibodies or to elicit another type of immune response; as a reagent (including the labeled reagent) in assays designed to quantitatively determine levels of the variant protein (or its binding partner) in biological fluids; as a marker for cells or tissues in which it is preferentially expressed (either constitutively or at a particular stage of tissue differentiation or development or in a disease state); as a target for screening for a therapeutic agent; and as a direct therapeutic agent to be administered into a human subject. Any of the variant proteins disclosed herein may be developed into reagent grade or kit format for commercialization as research products. Methods for performing the uses listed above are well known to those skilled in the art (see, e.g., Molecular Cloning: A Laboratory Manual, Cold Spring Harbor Laboratory Press, Sambrook and Russell, 2000, and Methods in Enzymology: Guide to Molecular Cloning Techniques, Academic Press, Berger, S. L. and A. R. Kimmel eds., 1987).

In a specific embodiment of the invention, the methods of the present invention include detection of one or more variant proteins disclosed herein. Variant proteins are disclosed in Table 1 and in the Sequence Listing as SEQ ID NOS:4-6. Detection of such proteins can be accomplished using, for example, antibodies, small molecule compounds, aptamers, ligands/substrates, other proteins or protein fragments, or other protein-binding agents. Preferably, protein detection agents are specific for a variant protein of the present invention and can therefore discriminate between a variant protein of the present invention and the wild-type protein or another variant form. This can generally be accomplished by, for example, selecting or designing detection agents that bind to the region of a protein that differs between the variant and wild-type protein, such as a region of a protein that contains one or more amino acid substitutions that is/are encoded by a non-synonymous cSNP of the present invention, or a region of a protein that follows a nonsense mutation-type SNP that creates a stop codon thereby leading to a shorter polypeptide, or a region of a protein that follows a read-through mutation-type SNP that destroys a stop codon thereby leading to a longer polypeptide in which a portion of the polypeptide is present in one version of the polypeptide but not the other.

In another specific aspect of the invention, the variant proteins of the present invention are used as targets for diagnosing psoriasis or for determining predisposition to psoriasis in a human. Accordingly, the invention provides methods for detecting the presence of, or levels of, one or more variant proteins of the present invention in a cell, tissue, or organism. Such methods typically involve contacting a test sample with an agent (e.g., an antibody, small molecule compound, or peptide) capable of interacting with the variant protein such that specific binding of the agent to the variant protein can be detected. Such an assay can be provided in a single detection format or a multi-detection format such as an array, for example, an antibody or aptamer array (arrays for protein detection may also be referred to as "protein chips"). The variant protein of interest can be isolated from a test sample and assayed for the presence of a variant amino acid sequence encoded by one or more SNPs disclosed by the present invention. The SNPs may cause changes to the protein and the corresponding protein function/activity, such as through non-synonymous substitutions in protein coding regions that can lead to amino acid substitutions, deletions, insertions, and/or rearrangements; formation or destruction of stop codons; or alteration of control elements such as promoters. SNPs may also cause inappropriate post-translational modifications.

One preferred agent for detecting a variant protein in a sample is an antibody capable of selectively binding to a variant form of the protein (antibodies are described in greater detail in the next section). Such samples include, for example, tissues, cells, and biological fluids isolated from a subject, as well as tissues, cells and fluids present within a subject.

In vitro methods for detection of the variant proteins associated with psoriasis that are disclosed herein and fragments thereof include, but are not limited to, enzyme linked immunosorbent assays (ELISAs), radioimmunoassays (RIA), Western blots, immunoprecipitations, immunofluorescence, and protein arrays/chips (e.g., arrays of antibodies or aptamers). For further information regarding immunoassays and related protein detection methods, see *Current Protocols in Immunology*, John Wiley & Sons, N.Y., and Hage, "Immunoassays", *Anal Chem.* 1999 Jun. 15; 71(12):294R-304R.

Additional analytic methods of detecting amino acid variants include, but are not limited to, altered electrophoretic mobility, altered tryptic peptide digest, altered protein activity in cell-based or cell-free assay, alteration in ligand or antibody-binding pattern, altered isoelectric point, and direct amino acid sequencing.

Alternatively, variant proteins can be detected in vivo in a subject by introducing into the subject a labeled antibody (or other type of detection reagent) specific for a variant protein. For example, the antibody can be labeled with a radioactive marker whose presence and location in a subject can be detected by standard imaging techniques.

Other uses of the variant peptides of the present invention are based on the class or action of the protein. For example, proteins isolated from humans and their mammalian orthologs serve as targets for identifying agents (e.g., small molecule drugs or antibodies) for use in therapeutic applications, particularly for modulating a biological or pathological response in a cell or tissue that expresses the protein. Pharmaceutical agents can be developed that modulate protein activity.

As an alternative to modulating gene expression, therapeutic compounds can be developed that modulate protein function. For example, many SNPs disclosed herein affect the amino acid sequence of the encoded protein (e.g., non-synonymous cSNPs and nonsense mutation-type SNPs). Such alterations in the encoded amino acid sequence may affect protein function, particularly if such amino acid sequence variations occur in functional protein domains, such as catalytic domains, ATP-binding domains, or ligand/substrate binding domains. It is well established in the art that variant proteins having amino acid sequence variations in functional domains can cause or influence pathological conditions. In such instances, compounds (e.g., small molecule drugs or antibodies) can be developed that target the variant protein and modulate (e.g., up- or down-regulate) protein function/activity.

The therapeutic methods of the present invention further include methods that target one or more variant proteins of the present invention. Variant proteins can be targeted using, for example, small molecule compounds, antibodies, aptamers, ligands/substrates, other proteins, or other protein-binding agents. Additionally, the skilled artisan will recognize that the novel protein variants (and polymorphic nucleic acid molecules) disclosed in Table 1 may themselves be directly used as therapeutic agents by acting as competitive inhibitors of corresponding art-known proteins (or nucleic acid molecules such as mRNA molecules).

The variant proteins of the present invention are particularly useful in drug screening assays, in cell-based or cell-free systems. Cell-based systems can utilize cells that naturally express the protein, a biopsy specimen, or cell cultures. In one embodiment, cell-based assays involve recombinant host cells expressing the variant protein. Cell-free assays can be used to detect the ability of a compound to directly bind to a variant protein or to the corresponding SNP-containing nucleic acid fragment that encodes the variant protein.

A variant protein of the present invention, as well as appropriate fragments thereof, can be used in high-throughput screening assays to test candidate compounds for the ability to bind and/or modulate the activity of the variant protein. These candidate compounds can be further screened against a protein having normal function (e.g., a wild-type/non-variant protein) to further determine the effect of the compound on the protein activity. Furthermore, these compounds can be tested in animal or invertebrate systems to determine in vivo activity/effectiveness. Compounds can be identified that activate (agonists) or inactivate (antagonists) the variant protein, and different compounds can be identified that cause various degrees of activation or inactivation of the variant protein.

Further, the variant proteins can be used to screen a compound for the ability to stimulate or inhibit interaction between the variant protein and a target molecule that normally interacts with the protein. The target can be a ligand, a substrate or a binding partner that the protein normally interacts with (for example, epinephrine or norepinephrine). Such assays typically include the steps of combining the variant protein with a candidate compound under conditions that allow the variant protein, or fragment thereof, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., *Nature* 354:82-84 (1991); Houghten et al., *Nature* 354:84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., *Cell* 72:767-778 (1993)); 3) antibodies (e.g., polyclonal, monoclonal, humanized, anti-idiotypic, chimeric, and single chain antibodies as well as Fab, F(ab')$_2$, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

Binding and/or activating compounds can also be screened by using chimeric variant proteins in which an amino terminal extracellular domain or parts thereof, an entire transmembrane domain or subregions, and/or the carboxyl terminal intracellular domain or parts thereof, can be replaced by heterologous domains or subregions. For example, a substrate-binding region can be used that interacts with a different substrate than that which is normally recognized by a variant protein. Accordingly, a different set of signal transduction components is available as an end-point assay for activation. This allows for assays to be performed in other than the specific host cell from which the variant protein is derived.

The variant proteins are also useful in competition binding assays in methods designed to discover compounds that interact with the variant protein. Thus, a compound can be exposed to a variant protein under conditions that allow the compound to bind or to otherwise interact with the variant protein. A binding partner, such as ligand, that normally interacts with the variant protein is also added to the mixture. If the test compound interacts with the variant protein or its binding partner, it decreases the amount of complex formed or activity from the variant protein. This type of assay is particularly useful in screening for compounds that interact with specific regions of the variant protein (Hodgson, *Bio/technology*, 1992, September 10(9), 973-80).

To perform cell-free drug screening assays, it is sometimes desirable to immobilize either the variant protein or a fragment thereof, or its target molecule, to facilitate separation of complexes from uncomplexed forms of one or both of the proteins, as well as to accommodate automation of the assay. Any method for immobilizing proteins on matrices can be used in drug screening assays. In one embodiment, a fusion protein containing an added domain allows the protein to be bound to a matrix. For example, glutathione-S-transferase/$^{125}$I fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads can be washed to remove any unbound label, and the matrix immobilized and radiolabel determined directly, or in the supernatant after the complexes are dissociated. Alternatively, the complexes can be dissociated from the matrix, separated by SDS-PAGE, and the level of bound material found in the bead fraction quantitated from the gel using standard electrophoretic techniques.

Either the variant protein or its target molecule can be immobilized utilizing conjugation of biotin and streptavidin. Alternatively, antibodies reactive with the variant protein but which do not interfere with binding of the variant protein to its target molecule can be derivatized to the wells of the plate, and the variant protein trapped in the wells by antibody conjugation. Preparations of the target molecule and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, and enzyme-linked assays that rely on detecting an enzymatic activity associated with the target molecule.

Modulators of variant protein activity identified according to these drug screening assays can be used to treat a subject with a disorder mediated by the protein pathway, such as psoriasis. These methods of treatment typically include the steps of administering the modulators of protein activity in a pharmaceutical composition to a subject in need of such treatment.

The variant proteins, or fragments thereof, disclosed herein can themselves be directly used to treat a disorder characterized by an absence of, inappropriate, or unwanted expression or activity of the variant protein. Accordingly, methods for treatment include the use of a variant protein disclosed herein or fragments thereof.

In yet another aspect of the invention, variant proteins can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) *Oncogene* 8:1693-1696; and Brent WO94/10300) to identify other proteins that bind to or interact with the variant protein and are involved in variant protein activity. Such variant protein-binding proteins are also likely to be involved in the propagation of signals by the variant proteins or variant protein targets as, for example, elements of a protein-mediated signaling pathway. Alternatively, such variant protein-binding proteins are inhibitors of the variant protein.

The two-hybrid system is based on the modular nature of most transcription factors, which typically consist of separable DNA-binding and activation domains. Briefly, the assay typically utilizes two different DNA constructs. In one construct, the gene that codes for a variant protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a variant protein-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected, and cell colonies containing the func-

Antibodies Directed to Variant Proteins

The present invention also provides antibodies that selectively bind to the variant proteins disclosed herein and fragments thereof. Such antibodies may be used to quantitatively or qualitatively detect the variant proteins of the present invention. As used herein, an antibody selectively binds a target variant protein when it binds the variant protein and does not significantly bind to non-variant proteins, i.e., the antibody does not significantly bind to normal, wild-type, or art-known proteins that do not contain a variant amino acid sequence due to one or more SNPs of the present invention (variant amino acid sequences may be due to, for example, nonsynonymous cSNPs, nonsense SNPs that create a stop codon, thereby causing a truncation of a polypeptide or SNPs that cause read-through mutations resulting in an extension of a polypeptide).

As used herein, an antibody is defined in terms consistent with that recognized in the art: they are multi-subunit proteins produced by an organism in response to an antigen challenge. The antibodies of the present invention include both monoclonal antibodies and polyclonal antibodies, as well as antigen-reactive proteolytic fragments of such antibodies, such as Fab, F(ab)'$_2$, and Fv fragments. In addition, an antibody of the present invention further includes any of a variety of engineered antigen-binding molecules such as a chimeric antibody (U.S. Pat. Nos. 4,816,567 and 4,816,397; Morrison et al., *Proc. Natl. Acad. Sci. USA*, 81:6851, 1984; Neuberger et al., *Nature* 312:604, 1984), a humanized antibody (U.S. Pat. Nos. 5,693,762; 5,585,089; and 5,565,332), a single-chain Fv (U.S. Pat. No. 4,946,778; Ward et al., *Nature* 334:544, 1989), a bispecific antibody with two binding specificities (Segal et al., *J. Immunol. Methods* 248:1, 2001; Carter, *J. Immunol. Methods* 248:7, 2001), a diabody, a triabody, and a tetrabody (Todorovska et al., *J. Immunol. Methods,* 248:47, 2001), as well as a Fab conjugate (dimer or trimer), and a minibody.

Many methods are known in the art for generating and/or identifying antibodies to a given target antigen (Harlow, Antibodies, Cold Spring Harbor Press, (1989)). In general, an isolated peptide (e.g., a variant protein of the present invention) is used as an immunogen and is administered to a mammalian organism, such as a rat, rabbit, hamster or mouse. Either a full-length protein, an antigenic peptide fragment (e.g., a peptide fragment containing a region that varies between a variant protein and a corresponding wild-type protein), or a fusion protein can be used. A protein used as an immunogen may be naturally-occurring, synthetic or recombinantly produced, and may be administered in combination with an adjuvant, including but not limited to, Freund's (complete and incomplete), mineral gels such as aluminum hydroxide, surface active substance such as lysolecithin, pluronic polyols, polyanions, peptides, oil emulsions, keyhole limpet hemocyanin, dinitrophenol, and the like.

Monoclonal antibodies can be produced by hybridoma technology (Kohler and Milstein, *Nature,* 256:495, 1975), which immortalizes cells secreting a specific monoclonal antibody. The immortalized cell lines can be created in vitro by fusing two different cell types, typically lymphocytes, and tumor cells. The hybridoma cells may be cultivated in vitro or in vivo. Additionally, fully human antibodies can be generated by transgenic animals (He et al., *J. Immunol.*, 169:595, 2002). Fd phage and Fd phagemid technologies may be used to generate and select recombinant antibodies in vitro (Hoogenboom and Chames, *Immunol Today* 21:371, 2000; Liu et al., *J. Mol. Biol.* 315:1063, 2002). The complementarity-determining regions of an antibody can be identified, and synthetic peptides corresponding to such regions may be used to mediate antigen binding (U.S. Pat. No. 5,637,677).

Antibodies are preferably prepared against regions or discrete fragments of a variant protein containing a variant amino acid sequence as compared to the corresponding wild-type protein (e.g., a region of a variant protein that includes an amino acid encoded by a nonsynonymous cSNP, a region affected by truncation caused by a nonsense SNP that creates a stop codon, or a region resulting from the destruction of a stop codon due to read-through mutation caused by a SNP). Furthermore, preferred regions will include those involved in function/activity and/or protein/binding partner interaction. Such fragments can be selected on a physical property, such as fragments corresponding to regions that are located on the surface of the protein, e.g., hydrophilic regions, or can be selected based on sequence uniqueness, or based on the position of the variant amino acid residue(s) encoded by the SNPs provided by the present invention. An antigenic fragment will typically comprise at least about 8-10 contiguous amino acid residues in which at least one of the amino acid residues is an amino acid affected by a SNP disclosed herein. The antigenic peptide can comprise, however, at least 12, 14, 16, 20, 25, 50, 100 (or any other number in-between) or more amino acid residues, provided that at least one amino acid is affected by a SNP disclosed herein.

Detection of an antibody of the present invention can be facilitated by coupling (i.e., physically linking) the antibody or an antigen-reactive fragment thereof to a detectable substance. Detectable substances include, but are not limited to, various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

Antibodies, particularly the use of antibodies as therapeutic agents, are reviewed in: Morgan, "Antibody therapy for Alzheimer's disease", *Expert Rev Vaccines.* 2003 February; 2(1):53-9; Ross et al., "Anticancer antibodies", *Am J Clin Pathol.* 2003 April; 119(4):472-85; Goldenberg, "Advancing role of radiolabeled antibodies in the therapy of cancer", *Cancer Immunol Immunother.* 2003 May; 52(5):281-96. Epub 2003 Mar. 11; Ross et al., "Antibody-based therapeutics in oncology", *Expert Rev Anticancer Ther.* 2003 February; 3(1):107-21; Cao et al., "Bispecific antibody conjugates in therapeutics", *Adv Drug Deliv Rev.* 2003 Feb. 10; 55(2):171-97; von Mehren et al., "Monoclonal antibody therapy for cancer", *Annu Rev Med.* 2003; 54:343-69. Epub 2001 Dec. 3; Hudson et al., "Engineered antibodies", *Nat Med.* 2003 January; 9(1):129-34; Brekke et al., "Therapeutic antibodies for human diseases at the dawn of the twenty-first century", *Nat Rev Drug Discov.* 2003 January; 2(1):52-62 (Erratum in: *Nat Rev Drug Discov.* 2003 March; 2(3):240); Houdebine, "Antibody manufacture in transgenic animals and comparisons with other systems", *Curr Opin Biotechnol.* 2002 December; 13(6):625-9; Andreakos et al., "Monoclonal antibodies in immune and inflammatory diseases", *Curr Opin Biotechnol.* 2002 December; 13(6):615-20; Kellermann et al., "Antibody discovery: the use of transgenic mice to generate human monoclonal antibodies for therapeutics", *Curr Opin Biotechnol.* 2002 December; 13(6):593-7; Pini et al., "Phage display and colony filter screening for high-throughput selection of antibody libraries", *Comb Chem High Throughput Screen.* 2002 November; 5(7):503-10; Batra et al., "Pharmacokinetics and biodistribution of genetically engineered antibodies", *Curr Opin Biotechnol.* 2002 December; 13(6):603-8; and Tangri et al., "Rationally engineered proteins or antibodies with absent or reduced immunogenicity", *Curr Med Chem.* 2002 December; 9(24):2191-9.

Uses of Antibodies

Antibodies can be used to isolate the variant proteins of the present invention from a natural cell source or from recombinant host cells by standard techniques, such as affinity chromatography or immunoprecipitation. In addition, antibodies are useful for detecting the presence of a variant protein of the present invention in cells or tissues to determine the pattern of expression of the variant protein among various tissues in an organism and over the course of normal development or disease progression. Further, antibodies can be used to detect variant protein in situ, in vitro, in a bodily fluid, or in a cell lysate or supernatant in order to evaluate the amount and pattern of expression. Also, antibodies can be used to assess abnormal tissue distribution, abnormal expression during development, or expression in an abnormal condition, such as psoriasis. Additionally, antibody detection of circulating fragments of the full-length variant protein can be used to identify turnover.

Antibodies to the variant proteins of the present invention are also useful in pharmacogenomic analysis. Thus, antibodies against variant proteins encoded by alternative SNP alleles can be used to identify individuals that require modified treatment modalities.

Further, antibodies can be used to assess expression of the variant protein in disease states such as in active stages of the disease or in an individual with a predisposition to a disease related to the protein's function, particularly psoriasis. Antibodies specific for a variant protein encoded by a SNP-containing nucleic acid molecule of the present invention can be used to assay for the presence of the variant protein, such as to screen for predisposition to psoriasis as indicated by the presence of the variant protein.

Antibodies are also useful as diagnostic tools for evaluating the variant proteins in conjunction with analysis by electrophoretic mobility, isoelectric point, tryptic peptide digest, and other physical assays well known in the art.

Antibodies are also useful for tissue typing. Thus, where a specific variant protein has been correlated with expression in a specific tissue, antibodies that are specific for this protein can be used to identify a tissue type.

Antibodies can also be used to assess aberrant subcellular localization of a variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of a variant protein, antibodies directed against the variant protein or relevant fragments can be used to monitor therapeutic efficacy.

The antibodies are also useful for inhibiting variant protein function, for example, by blocking the binding of a variant protein to a binding partner. These uses can also be applied in a therapeutic context in which treatment involves inhibiting a variant protein's function. An antibody can be used, for example, to block or competitively inhibit binding, thus modulating (agonizing or antagonizing) the activity of a variant protein. Antibodies can be prepared against specific variant protein fragments containing sites required for function or against an intact variant protein that is associated with a cell or cell membrane. For in vivo administration, an antibody may be linked with an additional therapeutic payload such as a radionuclide, an enzyme, an immunogenic epitope, or a cytotoxic agent. Suitable cytotoxic agents include, but are not limited to, bacterial toxin such as diphtheria, and plant toxin such as ricin. The in vivo half-life of an antibody or a fragment thereof may be lengthened by pegylation through conjugation to polyethylene glycol (Leong et al., *Cytokine* 16:106, 2001).

The invention also encompasses kits for using antibodies, such as kits for detecting the presence of a variant protein in a test sample. An exemplary kit can comprise antibodies such as a labeled or labelable antibody and a compound or agent for detecting variant proteins in a biological sample; means for determining the amount, or presence/absence of variant protein in the sample; means for comparing the amount of variant protein in the sample with a standard; and instructions for use.

Vectors and Host Cells

The present invention also provides vectors containing the SNP-containing nucleic acid molecules described herein. The term "vector" refers to a vehicle, preferably a nucleic acid molecule, which can transport a SNP-containing nucleic acid molecule. When the vector is a nucleic acid molecule, the SNP-containing nucleic acid molecule can be covalently linked to the vector nucleic acid. Such vectors include, but are not limited to, a plasmid, single or double stranded phage, a single or double stranded RNA or DNA viral vector, or artificial chromosome, such as a BAC, PAC, YAC, or MAC.

A vector can be maintained in a host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in prokaryotic or eukaryotic cells or in both (shuttle vectors).

Expression vectors typically contain cis-acting regulatory regions that are operably linked in the vector to the SNP-containing nucleic acid molecules such that transcription of the SNP-containing nucleic acid molecules is allowed in a host cell. The SNP-containing nucleic acid molecules can also be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region, a ribosome-binding site for translation. Other regulatory control elements for expression include initiation and termination codons as well as polyadenylation signals. A person of ordinary skill in the art would be aware of the numerous regulatory sequences that are useful in expression vectors (see, e.g., Sambrook and Russell, 2000, Molecular Cloning: A Laboratory Manual, Cold Spring Harbor Laboratory Press, Cold Spring Harbor, N.Y.).

A variety of expression vectors can be used to express a SNP-containing nucleic acid molecule. Such vectors include chromosomal, episomal, and virus-derived vectors, for example, vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors can also be derived from combinations of these sources such as those derived from plasmid and bacteriophage genetic elements, e.g., cosmids and phagemids. Appropriate cloning and expression vectors for prokaryotic and eukaryotic hosts are described in Sambrook and Russell, 2000, Molecular Cloning: A Laboratory Manual, Cold Spring Harbor Laboratory Press, Cold Spring Harbor, N.Y.

The regulatory sequence in a vector may provide constitutive expression in one or more host cells (e.g., tissue specific expression) or may provide for inducible expression in one or more cell types such as by temperature, nutrient additive, or exogenous factor, e.g., a hormone or other ligand. A variety of vectors that provide constitutive or inducible expression of a nucleic acid sequence in prokaryotic and eukaryotic host cells are well known to those of ordinary skill in the art.

A SNP-containing nucleic acid molecule can be inserted into the vector by methodology well-known in the art. Generally, the SNP-containing nucleic acid molecule that will ultimately be expressed is joined to an expression vector by cleaving the SNP-containing nucleic acid molecule and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial host cells include, but are not limited to, *E. coli, Streptomyces*, and *Salmonella typhimurium*. Eukaryotic host cells include, but are not limited to, yeast, insect cells such as *Drosophila*, animal cells such as COS and CHO cells, and plant cells.

As described herein, it may be desirable to express the variant peptide as a fusion protein. Accordingly, the invention provides fusion vectors that allow for the production of the variant peptides. Fusion vectors can, for example, increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety.

Proteolytic enzymes suitable for such use include, but are not limited to, factor Xa, thrombin, and enterokinase. Typical fusion expression vectors include pGEX (Smith et al., *Gene* 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., *Gene* 69:301-315 (1988)) and pET 11d (Studier et al., *Gene Expression Technology: Methods in Enzymology* 185:60-89 (1990)).

Recombinant protein expression can be maximized in a bacterial host by providing a genetic background wherein the host cell has an impaired capacity to proteolytically cleave the recombinant protein (Gottesman, S., *Gene Expression Technology: Methods in Enzymology* 185, Academic Press, San Diego, Calif. (1990) 119-128). Alternatively, the sequence of the SNP-containing nucleic acid molecule of interest can be altered to provide preferential codon usage for a specific host cell, for example, *E. coli* (Wada et al., *Nucleic Acids Res.* 20:2111-2118 (1992)).

The SNP-containing nucleic acid molecules can also be expressed by expression vectors that are operative in yeast. Examples of vectors for expression in yeast (e.g., *S. cerevisiae*) include pYepSec1 (Baldari, et al., *EMBO J.* 6:229-234 (1987)), pMFa (Kurjan et al., *Cell* 30:933-943 (1982)), pJRY88 (Schultz et al., *Gene* 54:113-123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol. Cell Biol.* 3:2156-2165 (1983)) and the pVL series (Lucklow et al., *Virology* 170:31-39 (1989)).

In certain embodiments of the invention, the SNP-containing nucleic acid molecules described herein are expressed in mammalian cells using mammalian expression vectors. Examples of mammalian expression vectors include pCDM8 (Seed, B. *Nature* 329:840 (1987)) and pMT2PC (Kaufman et al., *EMBO J.* 6:187-195 (1987)).

The invention also encompasses vectors in which the SNP-containing nucleic acid molecules described herein are cloned into the vector in reverse orientation, but operably linked to a regulatory sequence that permits transcription of antisense RNA. Thus, an antisense transcript can be produced to the SNP-containing nucleic acid sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include, for example, prokaryotic cells, lower eukaryotic cells such as yeast, other eukaryotic cells such as insect cells, and higher eukaryotic cells such as mammalian cells.

The recombinant host cells can be prepared by introducing the vector constructs described herein into the cells by techniques readily available to persons of ordinary skill in the art. These include, but are not limited to, calcium phosphate transfection, DEAE-dextran-mediated transfection, cationic lipid-mediated transfection, electroporation, transduction, infection, lipofection, and other techniques such as those described in Sambrook and Russell, 2000, Molecular Cloning: A Laboratory Manual, Cold Spring Harbor Laboratory, Cold Spring Harbor Laboratory Press, Cold Spring Harbor, N.Y.).

Host cells can contain more than one vector. Thus, different SNP-containing nucleotide sequences can be introduced in different vectors into the same cell. Similarly, the SNP-containing nucleic acid molecules can be introduced either alone or with other nucleic acid molecules that are not related to the SNP-containing nucleic acid molecules, such as those providing trans-acting factors for expression vectors. When more than one vector is introduced into a cell, the vectors can be introduced independently, co-introduced, or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication can occur in host cells that provide functions that complement the defects.

Vectors generally include selectable markers that enable the selection of the subpopulation of cells that contain the recombinant vector constructs. The marker can be inserted in the same vector that contains the SNP-containing nucleic acid molecules described herein or may be in a separate vector. Markers include, for example, tetracycline or ampicillin-resistance genes for prokaryotic host cells, and dihydrofolate reductase or neomycin resistance genes for eukaryotic host cells. However, any marker that provides selection for a phenotypic trait can be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

Where secretion of the variant protein is desired, which is difficult to achieve with multi-transmembrane domain containing proteins such as G-protein-coupled receptors (GPCRs), appropriate secretion signals can be incorporated into the vector. The signal sequence can be endogenous to the peptides or heterologous to these peptides.

Where the variant protein is not secreted into the medium, the protein can be isolated from the host cell by standard disruption procedures, including freeze/thaw, sonication, mechanical disruption, use of lysing agents, and the like. The variant protein can then be recovered and purified by well-known purification methods including, for example, ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that, depending upon the host cell in which recombinant production of the variant proteins described herein occurs, they can have various glycosylation patterns, or may be non-glycosylated, as when produced in bacteria. In addition, the variant proteins may include an initial modified methionine in some cases as a result of a host-mediated process.

For further information regarding vectors and host cells, see *Current Protocols in Molecular Biology*, John Wiley & Sons, N.Y.

Uses of Vectors and Host Cells, and Transgenic Animals

Recombinant host cells that express the variant proteins described herein have a variety of uses. For example, the cells are useful for producing a variant protein that can be further purified into a preparation of desired amounts of the variant protein or fragments thereof. Thus, host cells containing expression vectors are useful for variant protein production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function. Such an ability of a compound to modulate variant protein function may not be apparent from assays of the compound on the native/wild-type protein, or from cell-free assays of the compound. Recombinant host cells are also useful for assaying functional alterations in the variant proteins as compared with a known function.

Genetically-engineered host cells can be further used to produce non-human transgenic animals. A transgenic animal is preferably a non-human mammal, for example, a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more of its cell types or tissues. Such animals are useful for studying the function of a variant protein in vivo, and identifying and evaluating modulators of variant protein activity. Other examples of transgenic animals include, but are not limited to, non-human primates, sheep, dogs, cows, goats, chickens, and amphibians. Transgenic non-human mammals such as cows and goats can be used to produce variant proteins which can be secreted in the animal's milk and then recovered.

A transgenic animal can be produced by introducing a SNP-containing nucleic acid molecule into the male pronuclei of a fertilized oocyte, e.g., by microinjection or retroviral infection, and allowing the oocyte to develop in a pseudopregnant female foster animal. Any nucleic acid molecules that contain one or more SNPs of the present invention can potentially be introduced as a transgene into the genome of a non-human animal.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the variant protein in particular cells or tissues.

Methods for generating transgenic animals via embryo manipulation and microinjection, particularly animals such as mice, have become conventional in the art and are described in, for example, U.S. Pat. Nos. 4,736,866 and 4,870,009, both by Leder et al., U.S. Pat. No. 4,873,191 by Wagner et al., and in Hogan, B., *Manipulating the Mouse Embryo*, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes a non-human animal in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1 (Lakso et al. *PNAS* 89:6232-6236 (1992)). Another example of a recombinase system is the FLP recombinase system of *S. cerevisiae* (O'Gorman et al. *Science* 251: 1351-1355 (1991)). If a cre/loxP recombinase system is used to regulate expression of the transgene, animals containing transgenes encoding both the Cre recombinase and a selected protein are generally needed. Such animals can be provided through the construction of "double" transgenic animals, e.g., by mating two transgenic animals, one containing a transgene encoding a selected variant protein and the other containing a transgene encoding a recombinase.

Clones of the non-human transgenic animals described herein can also be produced according to the methods described in, for example, Wilmut, I. et al. *Nature* 385:810-813 (1997) and PCT International Publication Nos. WO 97/07668 and WO 97/07669. In brief, a cell (e.g., a somatic cell) from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell (e.g., a somatic cell) is isolated.

Transgenic animals containing recombinant cells that express the variant proteins described herein are useful for conducting the assays described herein in an in vivo context. Accordingly, the various physiological factors that are present in vivo and that could influence ligand or substrate binding, variant protein activation, signal transduction, or other processes or interactions, may not be evident from in vitro cell-free or cell-based assays. Thus, non-human transgenic animals of the present invention may be used to assay in vivo variant protein function as well as the activities of a therapeutic agent or compound that modulates variant protein function/activity or expression. Such animals are also suitable for assessing the effects of null mutations (i.e., mutations that substantially or completely eliminate one or more variant protein functions).

For further information regarding transgenic animals, see Houdebine, "Antibody manufacture in transgenic animals and comparisons with other systems", *Curr Opin Biotechnol.* 2002 December; 13(6):625-9; Petters et al., "Transgenic animals as models for human disease", *Transgenic Res.* 2000; 9(4-5):347-51; discussion 345-6; Wolf et al., "Use of transgenic animals in understanding molecular mechanisms of toxicity", *J Pharm Pharmacol.* 1998 June; 50(6):567-74; Echelard, "Recombinant protein production in transgenic animals", *Curr Opin Biotechnol.* 1996 October; 7(5):536-40; Houdebine, "Transgenic animal bioreactors", *Transgenic Res.* 2000; 9(4-5):305-20; Pirity et al., "Embryonic stem cells, creating transgenic animals", *Methods Cell Biol.* 1998; 57:279-93; and Robl et al., "Artificial chromosome vectors and expression of complex proteins in transgenic animals", *Theriogenology.* 2003 Jan. 1; 59 (1):107-13.

EXAMPLES

The following examples are offered to illustrate, but not to limit the claimed invention.

Example One

Statistical Analysis of SNPs Associated with Psoriasis

Further information regarding Example One is disclosed in Cargill et al., "A large-scale genetic association study confirms IL12B and leads to the identification of IL23R as psoriasis risk genes", *Am J Hum Genet.* 2007 February; 80(2): 273-90, which is incorporated herein by reference.

Overview

A multi-tiered, case-control association study of psoriasis was performed in three independent, white North American sample sets (a total of 1446 cases/1432 controls) with 26,644 gene-centric SNPs which identified an IL12B 3'UTR SNP (rs3212227) that was significantly associated with psoriasis in all three studies ($OR_{common}$=0.64, $P_{comb}$=7.85E-10). A Monte Carlo simulation to address multiple testing suggests this association is not the result of a type I error. The coding regions of IL12B were resequenced in 96 individuals with psoriasis and 30 additional IL12B-region SNPs genotyped. Haplotypes were estimated and genotype-conditioned analyses were performed identifying a second risk allele (rs6887695) located approximately 60 kb upstream of the IL12B-coding region that exhibited association with psoriasis after adjusting for rs3212227. Together these two SNPs mark a common IL12B-risk haplotype ($OR_{common}$=1.40, $P_{comb}$=8.11E-09) and a less frequent protective haplotype ($OR_{common}$=0.58, $P_{comb}$=5.65E-12) that were statistically significant in all three studies. Since IL12B encodes the common IL-12p40 subunit of both IL-12 and IL-23, 17 SNPs in the genes encoding the other chains of these two cytokines (IL12A and IL23A) and their receptors (IL12RB1, IL12RB2, IL23R) were individually genotyped. Haplotype analyses identified two IL23R missense SNPs that together mark a common psoriasis-associated haplotype in all three studies ($OR_{common}$=1.44, $P_{comb}$=3.13E-06). Individuals homozygous for both the IL12B and IL23R predisposing haplotypes appear to be at increased risk for disease ($OR_{common}$=1.66, $P_{comb}$=1.33E-08). These data, combined with the observation that administration of an antibody specific for the IL-12p40 subunit to psoriasis patients is highly efficacious, suggest that these genes play a fundamental role in psoriasis pathogenesis.

Introduction

A large, gene-centric association study focusing primarily on putative functional SNPs was carried out to identify psoriasis-susceptibility markers in white North American case-control samples and to attempt to replicate significant markers in a second independent case-control sample set. During this process, significant association of a SNP (rs3212227) in the 3'UTR of IL12B with psoriasis was observed in both case-control sample sets.

To explore the role of IL12B in the genetics of psoriasis and identify potentially causative variants, additional markers in and around IL12B were genotyped and further analyses were performed including haplotype analyses. Patients were stratified by clinically relevant variables and genotypes to identify phenotype-specific or gene interaction effects. Because IL12B encodes the IL-12p40 subunit of two distinct heterodimeric cytokines, IL-12 and IL-23[14], SNPs in IL12A, IL23A (encoding the IL-12p35 and IL-23p19 subunits, respectively) and the genes encoding the receptors of IL-12 and IL-23 (IL12RB1, IL12RB2, IL23R) were analyzed to determine if polymorphisms within these IL12B-related genes also play a role in psoriasis susceptibility. Finally, all interesting findings were replicated in a third independent white North American sample set.

Subjects and Methods
Overall Strategy

Three sequential, case-control studies (discovery, replication 1 and replication 2) were conducted to identify SNPs associated with psoriasis. In the discovery study, DNA samples from individuals with (cases) and without (controls) psoriasis were genotyped for 26,644 SNPs using disease-phenotype-based pooled DNAs to increase genotyping through-put and minimize DNA consumption. The allele frequency of each SNP was determined as previously described[15] and SNPs associated with psoriasis at the 0.05 significance level were evaluated in an independent sample set (replication study 1) by use of a similar pooling strategy. Non-MHC-linked SNPs associated with psoriasis in the replication study (P<0.05) with the same risk allele as in the discovery study were then individually genotyped in both discovery and replication 1 sample sets to verify the results from the pooled DNA studies. SNPs that were still significant (P<0.05) were then interrogated in a third, independent sample set (replication study 2). The results of those SNPs with P-values of less than 5.5E-05 from the pooled genotyping of the discovery sample set are report herein in Example One.

Subjects

The discovery samples were collected from 467 white individuals with psoriasis and 500 white individuals without psoriasis. The individuals with psoriasis were recruited from the University of Utah Department of Dermatology clinics as part of the Utah Psoriasis Initiative (UPI) and had a diagnosis of psoriasis confirmed by a UPI investigator. A full clinical work-up and questionnaire is available for each individual with psoriasis and samples from first or second degree relatives were not included in the study. Samples from 500 white individuals matched for age and gender were selected from the Utah CEPH population and other University of Utah research studies to serve as controls. Fifty-three percent of these individuals were without a reported history of autoimmune disease. The remainder of the control individuals represent the general Utah population; no information on their autoimmune disease status was available.

Replication sample set 1 was collected by the Genomics Collaborative Division of SeraCare Life Sciences (GCI; Cambridge, Mass.). Samples from 498 white North American individuals with a confirmed medical diagnosis of psoriasis and a Psoriasis Area and Severity Index (PASI) score and 498 white North American individuals without a history of psoriasis or other autoimmune disorders and individually matched to the cases by gender and age were included. Replication sample set 2, consisting of samples from 481 white North American individuals with psoriasis and 424 white North Americans without psoriasis, was used to confirm results from the two previous sample sets; samples from 293 individuals with psoriasis and 292 individuals without psoriasis were provided by GCI and met the criteria described above. BioCollections Worldwide, Inc. (Miami, Fla.) provided an additional 188 samples from individuals with psoriasis meeting the same criteria described above as well as samples from 132 white North Americans without psoriasis.

All individuals included in this study were over the age of 18 at the time they were enrolled into the sample collections. In addition, none of the subjects had undergone a bone marrow transplant. All protocols were approved by national and/or local institutional review boards, and informed written consent was obtained from all subjects. A detailed breakdown of the clinical characteristics of the discovery and replication sample set 1 is provided in Table 8. Detailed clinical information for all individuals with psoriasis in replication sample set 2 was limited. The female-male gender ratio was 0.89 and the average age of onset was 28±16 years: 138 patients (28.7%) had disease onset at <18 years of age, 180 patients (37.4%) between 18 and 32 years of age, and 163 patients (33.9%) after 32 years of age.

Scan SNP Selection.

Allele-specific, kinetic PCR assays were developed for a collection of 26,644 gene-centric SNPs curated from dbSNP, the Applera Genome Initiative[16,17] and the literature. SNPs were selected for inclusion if they appeared in more than one database and had a minor allele frequency (MAF) of greater than or equal to 1%. Approximately 70% of the SNPs are missense polymorphisms predicted to modify the amino acid sequences encoded by the genes. The majority of the remaining 30% of SNPs were splice site acceptor/donor SNPs, putative transcription factor binding site SNPs, etc. Approximately 75% of the SNPs have MAFs greater than or equal to 5%.

Allele Frequency and Genotype Determination

SNP allele frequencies in pooled DNAs were determined by allele-specific, kinetic PCR as previously described.[15,16] Briefly, 3 ng of pooled DNA was amplified using allele-specific primers and allele frequencies calculated from the two allele-specific PCR amplification curves, each determined in duplicate. Individual genotyping was performed using allele-specific kinetic PCR on 0.3 ng of DNA and the data hand-curated prior to statistical analysis. Previous analyses suggest a genotyping accuracy of >99%.[18,19] HLA-C genotypes were determined for the discovery samples by high-resolution sequence-based typing (performed by Atria Genetics, Inc.). HLA-C genotypes were not available for the other two sample sets.

Pools were constructed using an orthogonal design in which an individual DNA sample is arrayed into multiple pools based on the phenotypes (strata) to be studied (see Table 8 footnotes for a description of the pooling strategy for both the discovery and replication 1 sample sets). For the unstratified analyses (all cases vs. all controls) the allele frequency measurements in each stratum were combined and averaged based on the formula:

$$freq = \frac{1}{2n} \sum_j \left[ \left(\frac{2}{l_j}\right) \sum_i f_i p_{ij} \right]$$

$l_i$ is the number of pools that sample j appears in $$X_{ij} = \begin{cases} 1 & \text{if sample } j \text{ belongs to pool } i \\ 0 & \text{otherwise} \end{cases}$$

$f_i$=allele frequency estimate in pool i n is the number of distinct samples across all pools By using an orthogonal pooling strategy, based on clinically relevant phenotypes, and collapsing all the strata into an "all cases versus all controls" analysis, repeated measurements were essentially taken and therefore measurement error for the "all vs. all" comparison was reduced while maintaining the ability to examine associations with specific phenotypes.

IL12B Sequencing

To identify novel variants of IL12B, DNA from 96 randomly chosen individuals with psoriasis in replication sample set 1 were selected for resequencing. Sequence data from all 8 annotated exons and 5000 bp upstream of the 5'-most exon of IL12B, which spans approximately 17 kb, were extracted from the R27 draft of the Celera human genome sequence (NCBI accession number NW_922784). Primers were designed using the Primer3 program[20] and included the M13 forward (5' primer) or reverse (3' primer) universal sequencing primer-binding sequence at their 5' ends. PCR amplification and sequencing were performed as previously described.[19]

SNP Selection for Follow-Up Genotyping

Tagging-SNPs (tSNPs) for follow-up genotyping were selected by downloading the CEPH HapMap genotypes between positions 158, 464, 177 and 158, 828, 966 on chromosome 5 from the HapMap web site (release #12, October 2004) and running the computer program Redigo.[21] The approach used by this program maximizes the statistical power to detect truly-associated SNPs while minimizing the number of SNPs that are genotyped. For the power calculations, the following parameters were set: 500 cases, 500 controls, 0.95 power threshold, disease prevalence 0.01, and a conservative disease model [additive mode of inheritance with genotypic relative risk (GRR)=1.5]. As described by Hu and colleagues[21], use of a conservative disease model produces a tSNP set that is robust to changes in disease models.

LD Analysis and Haplotype Estimation

The LD measure $r^2$ was calculated from unphased data using the LDMAX program in the GOLD package.[22] Spotfire software was used to generate graphical representations of the $r^2$ LD matrix. A pseudo-Gibbs sampling algorithm from the program SNPAnalyzer version 1.0[23] was used to estimate haplotype and diplotype frequencies from unphased data. Cases and controls were treated separately in this process. The Haplo.Stats package was used to test for association between haplotypes and disease status.[24] The Haplo.Stats package is particularly useful on unphased data as it adjusts the variance on the test statistic for haplotype estimation error.

Association Statistics

Allele counts in the pooled DNAs were estimated from the allele-specific, kinetic PCR amplification curves as previously described.[15] A test of independence between allelic counts and disease status was performed using Fisher's exact test.[25] For contingency tables the William's-corrected G test was applied to evaluate the null hypothesis of independence between genotype counts and psoriasis status[26] except when the data were sparse. In that situation a Monte Carlo simulation approach was used to obtain appropriate P-values. To explore the extent of deviation from Hardy-Weinberg equilibrium, Weir's exact test for Hardy-Weinberg equilibrium was calculated.[27] As many disease models will predict a difference in pairwise linkage disequilibrium between samples from affected individuals and samples from unaffected individuals, the LD contrast test described by Nielsen and colleagues[28] was used to test for differences in linkage disequilibrium patterns between cases and controls. Fisher's combined P-value was employed to perform a joint analysis across independent studies. A Mantel-Haenszel common odds ratio was calculated across independent studies.[26] Genotypic relative risk estimates (γ) were calculated using a Bayesian approach modeling (a) the prevalence of disease as a Beta distribution having an expected disease prevalence of 2.3%, and (b) the genotype counts as being multinomially-distributed with parameters estimated from the empirical data. The Breslow-Day statistic[29] was used to determine whether SNPs exhibited significant heterogeneity of odds ratios across subphenotypes. A Cochran-Armitage trend test[30] was used to test for trends in association with quantitative traits such as age of onset and disease severity. Estimates of the population-attributable fraction were calculated as described by Walter[31] and Schlesselman.[32]

Since false positive results can be problematic in any large-scale experiment where modest nominal significance levels are used, a Monte Carlo simulation was performed to obtain the distribution of combined P-values across the two studies. Two null hypotheses were considered and the results presented under each hypothesis. Under the first model, which assumed independence between the cases and controls and a uniform distribution of P-values, 26,000 stochastically-independent P-values were generated retaining the top 1,500 most significant. A second set of 1,500 P-values were then generated under a uniform distribution to simulate P-values for the replication data set and the two P-values for each replicate combined using Fisher's combined P-value. The entire in silico experiment was repeated 1,000 times. The single most significant P-value from each in silico experiment was then used to generate a distribution of the thousand most-significant, experiment-wide P-values. This is analogous to results obtained under the Dunn-Sidak corrected significance level.[26] For the second model, a similar approach was used except that the results from the pooled discovery samples were used to model the distribution of null p-values. This approach is typically more conservative and is described in detail by Schrodi.[33] The resulting gamma null model was defined by scale and shape parameters of 1.2032 and 0.8517, respectively. Similar to other empirical-based methods used on large-scale studies to obtain null or alternative models,[34] this gamma-model method concurrently adjusts for diffuse effects of population stratification in a way similar to genomic control approaches.[35]

Similar to the haplotype method,[36,37] tests of association for a specific SNP conditional on genotypes at other SNPs was performed. That is, cases and controls were both partitioned based on genotypes at one SNP and the counts at an interrogated SNP were used in a test statistic. The statistical significance of the resulting test statistic was assessed using a permutation procedure. This type of test is useful in dissecting the relative contribution of each SNP to disease association for a set of SNPs in linkage disequilibrium.

To explore the likelihood of the data under various disease models, Bayes' factor curves[38,39] were calculated using data from all three studies. The results were compared against the likelihood of the data under a null hypothesis that accounts for diffuse population stratification. Mathematically, the Bayes' factor can be written as $B(R)=P[Data|H_D]/P[Data|H_0]$; where R is the allelic relative risk, $H_D$ is the disease model, a function of R, and $H_0$ is the null hypothesis.[33]

Results

Discovery Scan and Replication Data

A gene-centric set of 26,644 SNPs was genotyped in pooled discovery samples consisting of 466 white North American individuals with psoriasis (cases) (DNA for one of the 467 patients was not available at the time the pools were constructed) and 500 white North American individuals without psoriasis (controls) from Utah (see Methods and Table 8). This set of SNPs was highly enriched for missense, nonsense and regulatory polymorphisms.[16] The discovery scan on DNA pools yielded 32 markers with nominal p-values less than 5.5E-05, the majority of which mapped within or near the MHC (Table 9). These 32 markers were then genotyped in pooled replication 1 samples consisting of 498 white North American psoriasis cases and 498 white North American controls matched for age and gender. The majority of MHC-linked SNPs replicated (additionally, the frequency of the psoriasis-risk HLA allele, C*0602, was 22.4% in the discovery cases vs. 8.5% in the controls; OR=3.10, 95% CI 2.37-

4.08, P=2.37E-17), however only one of the seven non-MHC-linked markers, rs3212227, an A to C SNP in the 3' untranslated region of IL12B located on 5q, replicated the discovery findings with a nominal p-value of 1.88E-08 and consistent odds-ratio.

Individual genotyping of the IL12B 3'UTR marker, rs3212227, in the discovery and replication 1 samples showed that Hardy Weinberg equilibrium could not be rejected for this SNP in the cases and controls in both sample sets (P=0.847 in discovery cases and P=0.588 in discovery controls; P=0.297 in replication cases and P=0.913 in replication controls) and confirmed association of the A (major) allele with risk for psoriasis (discovery sample set: OR=1.59, P=1.89E-04; replication sample set 1: OR=1.81, P=7.59E-07) with a Fisher's combined allelic P-value of 3.39E-09 and an $OR_{common}$ of 1.70 (95% CI 1.43-2.01) (Table 10). The common A allele is increased in cases compared to controls (86% vs. 78-79%). The association at rs3212227 appears to be independent of HLA-C since stratification of the discovery patients and controls by presence or absence of the HLA-C*0602 risk allele did not result in significantly different odds ratios (HLA-C*0602 positive: OR=1.47, HLA-C*0602 negative: OR=1.61; Breslow-Day P-value=0.88).

Genotypic analysis of rs3212227 confirmed the single-marker results (Table 10). In a combined analysis of both sample sets, a single copy of the risk allele confers a modest risk ($OR_{common}$=1.47, 95% CI 0.86-2.50), whereas individuals homozygous for the A allele were at greater risk for psoriasis ($OR_{common}$=2.55, 95% CI 1.52-4.28). Bayesian estimates of relative risk, $\gamma$, for both the AA and CA genotypes (relative to the CC genotype) were also calculated in each sample set assuming disease prevalence was beta-distributed with a mean of 2.3% (Table 10). The resulting relative risk estimates, which are quite similar to the odds ratios, are also consistent with a general model of inheritance in which individuals carrying one copy of the A allele at rs3212227 are at increased risk for psoriasis relative to non-carriers while individuals carrying two copies have an even greater risk.

Since false positive results can be problematic in any large-scale experiment, a Monte Carlo simulation was performed to obtain an experiment-wide significance level. Two null hypotheses were considered and results presented under each. Under the first null model, which is similar to a Dunn-Sidak corrected significance level[26], independence between the cases and controls was assumed, generating a uniform distribution of P-values (see the Methods). The resulting combined P-values, which represent 1000 independent in silico experiments, ranged from 2.73E-04 to 2.58E-08 (Uniform-model. None of these are as significant as the calculated Fisher's combined P-value of 3.39E-09 for the IL12B 3'UTR SNP, rs3212227. The second model (Gamma-model), which uses the results from the pooled discovery samples to model the distribution of null P-values and is more conservative,[33] yielded 1,000 null combined P-values ranging from 1.53E-04 to 2.30E-09. Only one exceeded the significance of the Fisher's combined P-value of 3.39E-09 for the IL12B 3'UTR SNP. Taken together, these data suggest that association of the IL12B 3' UTR SNP with psoriasis is unlikely to be the result of a Type I error.

IL12B Sequencing in Patients with Psoriasis

In order to identify novel IL12B SNPs in patients with psoriasis, 1136 bases of 5' sequence, all exons and intron/exon boundaries, and 1424 bases of 3' sequence of IL12B were sequenced in 96 individuals with psoriasis from replication sample set 1. On average, 89 individuals (coverage ranged from 70 to 96 individuals) were successfully sequenced and 6 SNPs were identified, one of which was not found in public databases. The minor allele of this novel 3'UTR SNP (C158674941T; ss52085990) was observed on one chromosome in the 96 individuals sequenced.

Single-Marker Analysis of the IL12B Region

To further explore the association signal in the IL12B region, a combination of tagging SNPs (tSNPs), which had the highest average power to detect disease-associated variants under a conservative disease model, and functional SNPs in the discovery and replication 1 sample sets were genotyped. 32 tSNPs from a total of 44 white Phase I HapMap SNPs were selected using the program Redigo[21] in a region of 364.8 kb surrounding IL12B on chromosome 5, 27 of which produced high quality individual genotyping data in both the discovery and replication sample sets with minimal loss in average power (0.89 for 27 tSNPs compared to 0.90 for 32 tSNPs). A putative promoter polymorphism upstream of IL12B, ss52085993,[41,42] which has been shown to affect IL-12 and IL-12 Bp40 protein levels in stimulated cells, albeit inconsistently,[42-45] as well as two validated (SeattleSNPs resource) IL12B missense SNPs (rs3213119 and rs3213096) (Table 11) were also individually genotyped for a total of 30 additional SNPs in the IL12B region.

First, an exact test of Hardy-Weinberg Equilibrium (HWE) was used on the genotypic data for these 30 variants, the analysis was performed separately for cases and controls in each sample set (data not shown), and only two instances where a marker was not in HWE at the P<0.05 significance level (rs7721001 in the discovery controls, P=0.005; rs270654 in the replication cases, P=0.020) were identified.

Next, all 30 variants were analyzed for single-marker association with psoriasis susceptibility. In addition to the original hit, three other SNPs, rs3212220, rs7709212, and rs6887695, all of which lie upstream of the IL12B ATG start codon, were associated at the 0.05 level in an allelic test with consistent odds ratios (i.e., the psoriasis risk allele was the same) in both sample sets (Table 11).

Haplotype Analysis of the IL12B-Region SNPs

To localize additional disease-associated variants, the linkage disequilibrium patterns in this region were first examined by calculating the pairwise $r^2$ values between all 31 markers separately for the cases and controls in each study. The original hit, rs3212227, is in high LD with one of the tSNPs, rs3212220 (which lies in intron 1 upstream of the IL12B ATG start codon) ($r^2$>0.97 in the cases and controls of both sample sets), and in modest LD with rs1897565 ($r^2$: 0.25-0.33), ss52085993 ($r^2$: 0.12-0.23), rs7709212 ($r^2$: 0.28-0.40) and rs6887695 ($r^2$: 0.15-0.31) but exhibits little to no LD with the 25 other SNPs. Four other marker pairs show moderate LD ($0.50 < r^2 < 0.80$) in the cases and controls of both sample sets; however, the vast majority of the markers exhibited minimal LD between one another.

To focus on regions of interest, three marker, sliding window haplotypes for the 28 markers with a minor allele frequency of greater than 5% were generated for the cases and controls from both sample sets using the Haplo.Stats program[24] and global P-values were calculated to assess the overall haplotype frequency differences between the cases and controls for each 3-SNP window. Two peaks of replicated association with highly significant global P-values (P<0.0001) were observed. The first peak (w14-17) centers on the original marker, rs3212227, and rs3212220, which, as noted above, are in strong LD. The second peak (w22-24) centers on rs6887695. These three markers also showed the most significant single-marker association (Table 11).

Based on these results, subsequent analyses focused on the 13 SNPs with a MAF>5% encompassed by these two peaks (rs11744690-rs4921226 in Table 11). Detailed haplotype analyses of the SNPs in each peak as well as across the entire 144 kb region (all 13 SNPs) using Haplo.Stats (data not shown) suggested that 2 of these 13 SNPs, the original hit (rs3212227) and rs6887695, could explain the majority, if not all, of the association with psoriasis observed in both sample sets (Table 12). The 2-SNP haplotype containing the major allele of both SNPs (A@rs3212227-G@rs6887695) is significantly associated with risk in both sample sets (discovery sample set: 71.4% in cases vs. 63.8% in controls, OR=1.42, P=3.27E-04; replication sample set 1: 71.9% in cases vs. 63.4% in controls, OR=1.48, P=1.35E-05) while a second haplotype containing the minor allele at both SNPs (C-C) strongly confers protection (discovery sample set: 11% in cases vs. 16.6% in controls, OR=0.63, P=5.8E-04; replication sample set 1: 9.6% in cases vs. 19.0% in controls, OR=0.46, P=2.56E-09).

Since the putative promoter variant, ss52085993, has been associated with risk of other inflammatory-based diseases,[42,46] the haplotype analysis was specifically repeated including just ss52085993 along with rs3212227 and rs6887695. Alleles at ss52085993 do not appear to be responsible for the haplotype association (Table 13). Each allele is present on both risk and protective haplotypes and the significance of the results, as measured by global P-values, was not improved by inclusion of this marker in the analysis. A similar analysis was done with the two other significant SNPs in the single-marker analysis (rs3212220 and rs7709212 in Table 11). Inclusion of either or both along with rs3212227 and rs6887695 in the haplotype analysis did not increase the significance of the results (data not shown), suggesting association of both rs3212220 and rs7709212 with psoriasis in the single-marker analysis is most likely explained by LD with either rs3212227, rs6887695 or both.

Because the two implicated markers (rs3212227 and rs6887695) exhibit some LD ($r^2$: 0.15-0.31), a genotype-conditioned analyses similar to that described by Thomson and colleagues[36,37] was carried out to see if either SNP was associated with disease independent of the other SNP. To do this, a summary statistic was calculated for each sample set using the genotypes at one marker conditioned on the other marker and the significance of these observed results through a permutation test was evaluated. The results of 20,000 permutations for each sample set demonstrated that association of rs3212227 given rs6887695 (and rs6887695 given rs3212227) was significant at the 0.001 level in both sample sets, indicating that each SNP contributes independently to psoriasis risk.

Replication of IL12B Results in a Third Sample Set & Combined Analyses

These results were then replicated in a third independent sample set consisting of 481 white North American individuals with psoriasis and 424 white North American controls by individually genotyping rs3212227 and rs6887695. Allele frequencies were comparable across all three sample sets and single-marker analysis confirmed that both SNPs were significantly associated with psoriasis (rs3212227: P=0.014; rs6887695: P=0.007) (Table 11). The combined analysis for each individual SNP across all three sample sets was highly significant (rs3212227: $P_{comb}$=7.85E-10; rs6887695: $P_{comb}$=4.08E-08). Haplotypes were also estimated in the third sample set confirming the common IL12B risk haplotype (OR=1.31, P=6.00E-03) as well as the less frequent protective haplotype (OR=0.70, P=7.00E-03) (Table 12). Again, the combined analyses across all three sample sets were highly significant (the frequency of the common risk A-G haplotype is approximately 71-72% in cases vs 64% in controls, $OR_{common}$=1.40, 95% CI=1.25-1.57, $P_{comb}$=8.11E-09; the frequency of protective C-C haplotype is 10-12% in cases vs 17-19% in controls, $OR_{common}$=0.58, 95% CI=0.50-0.68, $P_{comb}$=5.65E-12) (Table 12). Together these data provide convincing statistical evidence that the IL12B-region on 5q31.1-33.1 harbors a psoriasis susceptibility locus.

Analysis of IL12B Related Genes

IL12B encodes the common IL-p40 subunit of two heterodimeric cytokines, IL-12 and IL-23, each with a distinct subunit encoded by the genes IL12A (IL-12p35) and IL23A (IL-23p19). The IL-12 and IL-23 receptors also share a common subunit, encoded by IL12RB1, in addition to their unique components, IL23R for the IL-23 receptor and IL12RB2 for the IL-12 receptor. To determine whether variants of these related genes might be associated with psoriasis, the results of the 26,644 SNP genome-wide scan were examined for markers in or near these 5 genes and assays were identified for 17 SNPs (7 in IL12A, 2 in IL23A, 4 in IL12RB1, 1 in IL12RB2 and 3 in IL23R) in the discovery sample set. One of these SNPs was significantly associated (P<0.05) with psoriasis in pooled DNAs from the discovery sample set, a missense SNP (L310P, rs7530511) in IL23R (data not shown).

To validate these results, all 17 SNPs were individually genotyped in the discovery sample set, the association of rs7530511 with psoriasis was confirmed (allele frequency 10.3% in cases, 14.6% in controls, OR=0.67, P=0.006), and a SNP in IL12A, rs2914119, was identified that was significant by individual genotyping (allele frequency 16% in cases, 19.6% in controls, OR=0.78, P=0.045) (Table 14). In addition, haplotype analyses of the SNPs in each gene were carried out (data not shown). Since IL23R and IL12RB2 lie directly adjacent to one another on chromosome 1, all 4 SNPs in these 2 genes were used together in the haplotype analysis of this region. A second IL23R SNP, rs11209026, was found to be associated with psoriasis risk in combination with rs7530511 (Global P-value=0.004) (Table 15). The most common haplotype marked by these two SNPs, C@s7530511-G@s11209026, was increased in patients compared to controls (85.2% vs. 79.3%, OR=1.5, P=9.48E-04).

The two IL23R SNPs and the IL12A SNP were then individually genotyped in replication sample set 1 (Table 14). The second IL23R SNP (rs11209026) was significantly associated with psoriasis in this sample set (P=0.004). Of most interest, however, was the observation that the common IL23R haplotype marked by the two SNPs rs7530511 and rs11209026 (C-G) was also associated with psoriasis risk in replication sample set 1 (haplotype frequency is 84.3% in cases vs. 79.7% in controls, OR=1.37, P=0.006) (Table 15). These findings were confirmed in the second replication sample set (Tables 14-15) and the combined analysis across all three sample sets was highly significant (frequency of the risk C-G haplotype was ~85% in cases vs. 80% in controls, $OR_{common}$=1.44, 95% CI=1.25-1.65, $P_{comb}$=3.13E-06) providing strong statistical evidence for a psoriasis-susceptibility gene on 1p31. It is interesting to note that these two IL23R SNPs are both missense SNPs (rs7530511: L310P; rs11209026: Q381R) with an $r^2$ value between them of less than 0.01 in the cases and controls of all three sample sets (data not shown). The common risk haplotype carries a proline at amino acid 310 with an arginine at amino acid 381. Both of these amino acids are conserved in chimp, mouse, rat, cow, dog and chicken.

Additional Statistical Support of IL12B and IL23R Haplotypes

Complementing traditional homogeneity tests, significant differences in LD patterns between cases and controls can also indicate disease association. The test described in the Nielsen et al study[28] was applied to pairs of SNPs in IL12B and IL23R. The results show departures between case and control pairwise values of D at rs3212227-rs6887695 for IL12B as expected under a disease model: $P_{cs\text{-}dis,ct\text{-}dis}=0.0129$; $P_{cs\text{-}rep1,ct\text{-}rep1}=5.16\text{E-}08$; $P_{cs\text{-}rep2,ct\text{-}rep2}=0.0497$; $P_{comb}=1.05\text{E-}08$. With regard to rs7530511-rs11209026 at IL23R, the LD contrast test yielded similar significant P-values: $P_{cs\text{-}dis,ct\text{-}dis}=0.0085$; $P_{cs\text{-}rep1,ct\text{-}rep1}=0.0019$; $P_{cs\text{-}rep2,ct\text{-}rep2}=0.0019$ $P_{comb}=5.30\text{E-}06$. As population stratification and other sampling irregularities can generate departures of pairwise LD measures from their null distribution, the LD contrast test was performed on all combinations of control-control (i.e., discovery controls vs replication 1 controls, discovery controls vs replication 2 controls, etc.), case-case and case-control samples in an attempt to better understand the significance of the observed IL12B and IL23R results. In all instances for both genes, case-control comparisons were statistically significant while the case-case and control-control comparisons were not, furthering support for the conclusions presented here (results not shown).

Bayes' factor curves were calculated for the risk rs3212227-rs6887695 haplotype at IL12B and the risk rs7530511-rs11209026 haplotype IL23R. Bayes' factors were adjusted for population stratification and combined across the three independent studies.[33] These results show a maximum $\text{Log}_{10}B(R)$ of 6.85 for the IL12B haplotype data, occurring at R=1.41. Hence, given equal prior probabilities for disease and null models, the probability of the disease hypothesis given the data is approximately 7 million-fold larger (at a disease model of R=1.41) than the probability of the null hypothesis conditioned on the data. Further, the $\text{Log}_{10}B(R)$ is above 4 as R spans 1.15 to 1.73—testifying to the strength, robustness and specificity of the result. Similar results were observed for the IL23R haplotype data with a maximum $\text{Log}_{10}B(R)$ of 5.78 at R=1.47. $\text{Log}_{10}B(R)$ remains above 4 for the relatively narrow range of 1.20<R<1.80.

Diplotype Analyses

To better understand how both these genes influence risk of disease for individuals, the impact of diplotypes at each locus independently and then jointly on psoriasis risk was assessed. Of the ten possible 2-SNP IL12B diplotypes, nine were observed in the sample sets (Table 16). The combined results from all three sample sets suggest there is a hierarchy of risk depending on an individual's IL12B diplotype. Psoriasis susceptibility appears to be conferred by two copies of the common risk haplotype (A-G/A-G: $OR_{common}=1.52$, 95% CI=1.31-1.77, $P_{comb}=6.14\text{E-}07$) which is found in approximately 48-51% of cases vs 38-40% of controls. Individuals who carry a copy of both the risk haplotype (A-G) and the protective haplotypes (A-G/C-C) appear to be protected ($OR_{common}=0.67$, 95% CI=0.55-0.81, $P_{comb}=1.39\text{E-}04$). Although individuals homozygous for the protective haplotype (C-C/C-C) are relatively uncommon (~1% of cases vs 2.3% of controls), the data presented here suggest their risk of psoriasis may be even lower ($OR_{common}=0.38$, 95% CI 0.19-0.68, $P_{comb}=0.018$). The population-attributable fraction[31,32] summarized across all three sample sets for the homozygous susceptible A-G/A-G IL12B diplotype relative to all other diplotypes collapsed together was calculated to be 17.1% [95% CI 11.4%-22.5%]).

At the IL23R locus, 7 of the 10 possible 2-SNP diplotypes were observed (Table 17). The data from all three sample sets suggest that individuals homozygous for the susceptible C-G haplotype are at increased risk for psoriasis ($OR_{common}=1.48$, 95% CI=1.26-1.74, $P_{comb}=2.24\text{E-}05$) while all other diplotypes appear to be neutral or protective. The estimated population-attributable fraction[31,32] summarized across all three sample sets for the IL23R homozygous risk diplotype (C-G/C-G) relative to all other diplotypes collapsed together is 23.5% (95% CI 14.9%-31.5%).

To assess the joint impact of the IL12B and IL23R susceptible haplotypes, the distribution of diplotypes at both genes comparing cases and controls in all three sample sets was determined (Table 18). Given the large number of possible diplotypes across these two loci relative to the number of cases and controls, the analysis concentrated on the risk haplotypes at each locus (A-G for IL12B and C-G for IL23R) and the three non-risk haplotypes at each locus were grouped into a single haplotype (indicated as X for both loci in Table 18). The combined analysis shows that individuals homozygous for both the IL12B and IL23R predisposing haplotypes, approximately 35-37% of cases vs 24-27% of controls, appear to be at increased risk for psoriasis ($OR_{common}=1.66$, 95% CI 1.41-1.95, $P_{comb}=1.33\text{E-}08$). A preliminary meta-analysis of the available data suggests minimally a 3-fold difference in risk between individuals who carry one copy of the protective C-C IL12B haplotype and one copy of the protective C-A IL23R haplotype (C-C/X-C-A/X) relative to individuals who are homozygous for risk haplotypes at both loci (A-G/A-G-C-G/C-G) (data not shown).

Discussion

The identification of two psoriasis-susceptibility genes, IL12B and IL23R are disclosed in this Example. These genes were identified using a collection of over 26,000 primarily "functional" SNPs evaluated in three independent case-control sample sets (a total of 1446 patients and 1432 controls) in a multi-staged strategy that combined pooled and individual genotyping along with single-marker as well as multi-marker analyses.

As described in this Example, a second SNP upstream of IL12B, rs6887695, independently contributes to psoriasis risk and, together with rs3212227, these two SNPs mark a set of haplotypes having a hierarchy of psoriasis risk.

Regarding the effect of the 3'UTR rs3212227 SNP on IL-12 and IL-12p40 expression levels, results using primary PBMCs suggest that IL12B transcripts containing the A allele are expressed at a higher level than transcripts containing the C allele when the RNAs from nine heterozygous donors stimulated with LPS were measured using allele-specific, quantitative, reverse transcription-PCR; however, significant individual variability in IL12B transcript levels was observed.

Both IL-12 and IL-23 have been proposed as targets for the treatment of psoriasis. IL-12p40 antagonists have been used for the effective treatment of a number of animal models of inflammatory-based diseases including a mouse model of psoriasis[65] and monoclonal antibodies directed against the IL-12p40 subunit are now in clinical trials for Crohn's disease, multiple sclerosis, and psoriasis.[66-68] Preliminary results show one of these biologics to be highly effective for psoriasis treatment.[67] However, given that IL12B encodes the common subunit of two functionally-distinct cytokines, IL-12 and IL-23,[14,69] this antibody effectively functions as a broad-spectrum immune modulator, leading some to suggest that targeting only one of these cytokine pathways may be a safer yet equally effective therapy.[70]

Biological data suggest the IL-23 pathway may be an important target for intervention in psoriasis. Psoriasis patients have significantly increased levels of IL23A and IL12B mRNA, but not IL12A mRNA, in psoriatic lesions compared with non-lesional skin as determined by quantitative reverse transcription polymerase chain reaction.[71] This has recently been confirmed by immunohistochemical staining.⁷² Moreover, in a transgenic mouse model that overexpressed IL-12p40, IL-23 but not IL-12 was observed to be constitutively expressed by basal keratinocytes which are thought to play a pivotal role in psoriasis pathobiology.⁷³ The findings presented in this Example that common variants in both IL12B and IL23R are associated with psoriasis risk provides genetic evidence that the IL-23 pathway may be an appropriate target for intervention in psoriasis.

Thus, convincing statistical support is provided in this Example for two psoriasis susceptibility loci—one in 5q31.1-q33.1 (IL12B-region) and the other in 1p31.3 (IL23R-region)—and analyses suggest the combination of risk and protective haplotypes at both loci can lead to more than a 3-fold differential risk for disease. These data justify targeting both the IL-12 and IL-23 pathways with new psoriasis therapeutics and suggest that targeting IL-23 or downstream effector cytokines such as IL-17 may directly target the disease pathway and prove efficacious for the treatment of psoriasis. Furthermore, the identified IL12B and IL23R psoriasis-associated alleles may be associated with response to anti-IL-12p40 therapy and/or the most effective dosage of this therapy.

REFERENCES

1. Lebwohl M. (2003) Psoriasis. Lancet 361:1197-204
2. Bowcock A M (2005) The genetics of psoriasis and autoimmunity. Annu Rev Genomics Hum Genet. 6:93-122
3. Gladman D D, Antoni C, Mease P, Clegg D O, Nash P (2005) Psoriasis arthritis: epidemiology, clinical features, course, and outcome. Ann Rheum Dis 64(Suppl):ii14-ii17
4. Bhalerao J, Bowcock A M (1998) The genetics of psoriasis: a complex disorder of the skin and immune system. Hum Mol Genet. 7:1537-45
5. Bowcock A M, Krueger J G (2005) Getting under the skin: the immunogenetics of psoriasis. Nat Rev Immunol 5:699-711
6. Helms C, Saccone N L, Cao L, Daw J A, Cao K, Hsu T M, Taillon-Miller P, Duan S, Gordon D, Pierce B, Ott J, Rice J, Fernandez-Vina M A, Kwok P Y, Menter A, Bowcock A M. (2005) Localization of PSORS1 to a haplotype block harboring HLA-C and distinct from corneodesmosin and HCR. Hum Genet. 118:466-476
7. Nair R P, Stuart P E, Nistor I, Hiremagalore R, Chia N V, Jenisch S, Weichenthal M, Abecasis G R, Lim H W, Christophers E, Voorhees J J, Elder J T. (2006) Sequence and haplotype analysis supports HLA-C as the psoriasis susceptibility 1 gene. Am J Hum Gen 78:827-851
8. Helms C, Cao L, Krueger J G, Wijsman E M, Chamian F, Gordon D, Heffernan M, Daw J A, Robarge J, Ott J, Kwok P Y, Menter A, Bowcock A M. (2003) A putative RUNX1 binding site variant between SLC9A3R1 and NAT9 is associated with susceptibility to psoriasis. Nat Genet 4:349-356
9. Hewett D, Samuelsson L, Polding J, Enlund F, Smart D, Cantone K, See C G, Chadha S, Inerot A, Enerback C, Montgomery D, Christodolou C, Robinson P, Matthews P, Plumpton M, Wahlstrom J, Swanbeck G, Martinsson T, Roses A, Riley J, Purvis I. (2002) Identification of a psoriasis susceptibility candidate gene by linkage disequilibrium mapping with a localized single nucleotide polymorphism map. Genomics 3:305-314
10. Hirschhorn J N, Daly M J (2005) Genome-wide association studies for common diseases and complex traits. Nat Rev Genet 6:95-108
11. Long A D, Langley C H (1999) The power of association studies to detect the contribution of candidate genetic loci to variation in complex traits. Genome Res 9:720-731
12. Risch N, Merikangas K (1996) The future of genetic studies of complex human diseases. Science 273: 1516-1517
13. Tsunemi Y, Saeki H, Nakamura K, Sekiya T, Hirai K, Fujita H, Asano N, Kishimoto M, Tanida Y, Kakinuma T, Mitsui H, Tada Y, Wakugawa M, Torii H, Komine M, Asahina A, Tamaki K. (2002) Interleukin-12 p40 gene (IL12B) 3'-untranslated region polymorphism is associated with susceptibility to atopic dermatitis and psoriasis vulgaris. J Dermatol Sci 30:161-166
14. Oppmann B, Lesley R, Blom B, Timans J C, Xu Y, Hunte B, Vega F, Yu N, Wang J, Singh K, Zonin F, Vaisberg E, Churakova T, Liu M, Gorman D, Wagner J, Zurawski S, Liu Y, Abrams J S, Moore K W, Rennick D, de Waal-Malefyt R, Hannum C, Bazan J F, Kastelein R A (2000) Novel p19 protein engages IL12p40 to form a cytokine, IL-23, with biological activities similar as well as distinct from IL-12. Immunity 13:715-725
15. Germer S, Holland M J, Higuchi R (2000) High-throughput SNP allele-frequency determination in pooled DNA samples by kinetic PCR. Genome Res 10:258-266
16. Shiffman D, Ellis S G, Rowland C M, Malloy M J, Luke M M, Iakoubova O A, Pullinger C R, Cassano J, Aouizerat B E, Fenwick R G, Reitz R E, Catanese J J, Leong D U, Zellner C, Sninsky J J, Topol E J, Devlin J J, Kane J P. (2005) Identification of four gene variants associated with myocardial infarction. Am J Hum Genet 77:596-605
17. Bustamante C D, Fledel-Alon A, Williamson S, Nielsen R, Hubisz M T, Glanowski S, Tanenbaum D M, White T J, Sninsky J J, Hernandez R D, Civello D, Adams M D, Cargill M, Clark A G. (2005) Natural selection on protein-coding genes in the human genome. Nature 437:1153-1157
18. Li Y, Tacey K, Doil L, van Luchene R, Garcia V, Rowland C, Schrodi S, Leong D, Lau K, Cantanese J, Sninsky J, Nowotny P, Holmans P, Hardy J, Powell J, Lovestone S, Thal L, Owen M, Williams J, Goate A, Grupe A (2004) Association of ABCA1 with late-onset Alzheimer's disease is not observed in a case-control study. Neurosci Lett 366:268-271
19. Carlton V E H, Hu X, Chokkalingam A P, Schrodi S J, Brandon R, Alexander H C, Chang M, Catanese J J, Leong D U, Ardlie K G, Kastner D L, Seldin M F, Criswell L A, Gregersen P K, Beasley E, Thomson G, Amos C I, Begovich A B. (2005) *PTPN22* genetic variation: evidence for multiple variants associated with rheumatoid arthritis. Am J Hum Gen 77:567-581
20. Rozen S, Skaletsky H (2000) Primer3 on the WWW for general users and for biologist programmers. In Krawetz S, Misener S (eds) Bioinformatics Methods and Protocols: Methods in Molecular Biology. Humana Press, Totowa, N.J., pp 365-386
21. Hu X, Schrodi S J, Ross D A, Cargill, M. (2004) Selecting tagging SNPs for association studies using power calculations from genotype data. Hum Hered 57:156-170
22. Abecasis G R, Cookson W O (2000) GOLD—graphical overview of linkage disequilibrium. Bioinformatics 16:182-183
23. Yoo J, Seo B, Kim Y (2005) SNPAnalyzer: a web-based integrated workbench for single-nucleotide polymorphism analysis. Nucleic Acids Res 33:W483-W488
24. Schaid D J, Rowland C M, Tines D E, Jacobson R M, Poland G A (2002) Score tests for association between traits and haplotypes when linkage phase is ambiguous. Am J Hum Genet 70:425-434

25. Fisher R A (1954) Statistical Methods for Research Workers. 12th ed. Oliver & Boyd, Edinburgh 26. Sokal R R, Rohlf F J (1995) Biometry $3^{rd}$ ed. W. H. Freeman and Company, New York USA 27. Weir B S (1996) Genetic Data Analysis II. Sinauer, Sunderland, M A 28. Nielsen D M, Ehm M G, Zaykin D V, Weir B S (2004) Effect of two- and three-locus linkage disequilibrium on the power to detect marker/phenotype associations. Genetics 168:1029-1040

29. Breslow N E, Day N E (1980) Statistical Methods in Cancer Research, Volume I: The analysis of case-control studies. Lyon: IARC 30. Agresti A (1990) Categorical Data Analysis. Wiley, New York 31. Walter S D (1975) The distribution of Levin's measure of attributable risk. Biometrika 62:371-374

32. Schlesselman J J (1982) Case-control studies: design, conduct, analysis. Oxford University Press, New York 33. Schrodi S J (2005) A probabilistic approach to large-scale association scans: a semi-Bayesian method to detect disease-predisposing alleles. Stat Appl Genet Mol Biol 4: article 31

34. Efron B, Tibshirani R, Storey J D, Tusher V (2001) Empirical Bayes analysis of a microarray experiment. J Am Stat Assoc 96:1151-1160

35. Devlin B, Roeder K (1999) Genomic control for association studies. Biometrics 55:997-1004

36. Thomson G, Robinson W P, Kuhner M K, Joe S, MacDonald M J, Gottschall J L, Barbosa J, Rich S S, Bertrams J, Baur M P, Partanen J, Tait B, Schober E, Mayr W R, Ludvigsson J, Lindblom B, Farid N R, Thompson C, Deschamps I (1988) Genetic heterogeneity, modes of inheritance, and risk estimates for a joint study of Caucasians with insulin-dependent diabetes mellitus. Am J Hum Genet 43:799-816

37. Valdes A M, Thomson G (1997) Detecting disease-predisposing variants: the haplotype method. Am J Hum Genet. 60:703-716

38. Jeffreys H (1935) Some tests of significance, treated by the theory of probability. Proc Camb Phil Soc 31:203-222

39. Kass R, Raftery A (1995) Bayes factors and model uncertainty. J Am Stat Assoc 90:773-795

40. Ahmad T, Neville M, Marshall S E, Armuzzi A, Mulcahy-Hawes K, Crawshaw J, Sato H, Ling K L, Barnardo M, Goldthorpe S, Walton R, Bunce M, Jewell D P, Welsh K I (2003) Haplotype-specific linkage disequilibrium patterns define the genetic topography of the human MHC. Hum Mol Genet 12:647-656

41. Huang D, Cancilla M R, Morahan G (2000) Complete primary structure, chromosomal localisation, and definition of polymorphisms of the gene encoding the human interleukin-12 p40 subunit. Genes Immun 1:515-520

42. Morahan G, Huang D, Wu M, Holt B J, White G P, Kendall G E, Sly P D, Holt P G. (2002) Association of IL12B promoter polymorphism with severity of atopic and non-atopic asthma in children. Lancet 360:455-459

43. Litjens N H, van der Plas M J, Ravensbergen B, Numan-Ruberg S C, van Assen Y, Thio H B, van Dissel J T, van de Vosse E, Nibbering P H. (2004) Psoriasis is not associated with IL-12p70/IL-12p40 production and IL12B promoter polymorphism. J Invest Dermatol 122:923-926

44. Muller-Berghaus J, Kern K, Paschen A, Nguyen X D, Kluter H, Morahan G, Schadendorf D. (2004) Deficient IL-12p70 secretion by dendritic cells based on IL12B promoter genotype. Genes Immun 5:431-434

45. Yilmaz V, Yentur S P, Saruhan-Direskeneli G (2005) IL-12 and IL-10 polymorphisms and their effects on cytokine production. Cytokine 30:188-194

46. Morahan G, Boutlis C S, Huang D, Pain A, Saunders J R, Hobbs M R, Granger D L, Weinberg J B, Peshu N, Mwaikambo E D, Marsh K, Roberts D J, Anstey N M. (2002) A promoter polymorphism in the gene encoding interleukin-12 p40 (IL12B) is associated with mortality from cerebral malaria and with reduced nitric oxide production. Genes Immun 3:414-418

47. Gregersen P K, Lee H S, Batliwalla F, Begovich A B (2006) PTPN22: Setting thresholds for autoimmunity. Semin Immunol 18:214-223

48. Marrack P, Kappler J, Kotzin B L (2001) Autoimmune disease: why and where it occurs. Nat Med 7:899-905

49. Wandstrat A, Wakeland E (2001) The genetics of complex autoimmune disease: non-MHC susceptibility genes. Nat. Immunol. 2:802-809

50. Begovich A B, Carlton V E H, Honigberg L A, Schrodi S J, Chokkalingam A P, Alexander H C, Ardlie K G, et al (2004) A missense single-nucleotide polymorphism in a gene encoding a protein tyrosine phosphatase (PTPN22) is associated with rheumatoid arthritis. Am J Hum Genet. 75:330-337

51. Hall M A, McGlinn E, Coakley G, Fisher S A, Boki K, Middleton D, Kaklamani E, Moutsopoulos H, Loughran T P Jr, Ollier W E, Panayi G S, Lanchbury J S. (2000) Genetic polymorphism of IL-12 p40 gene in immune-mediated disease. Genes Immun 1:219-224

52. Orozco G, Gonzalez-Gay M A, Paco L, Lopez-Nevot M A, Guzman M, Pascual-Salcedo D, Balsa A, Martin J (2005) Interleukin 12 (IL12B) and interleukin 12 receptor (IL12RB1) gene polymorphisms in rheumatoid arthritis. Hum Immunol 66:710-715

53. Shiffman D, Rowland C M, Louie J Z, Luke M M, Bare L A, Bolonick J I, Young B A, Catanese J J, Stiggins C F, Pullinger C R, Topol E J, Malloy M J, Kane J P, Ellis S G, Devlin J J (2006) Gene variants of VAMP8 and HNRPUL1 are associated with early-onset myocardial infarction. Arterioscler Thromb Vasc Biol 26:1613-1618

54. Huang H, Shiffman M L, Cheung R C, Layden T J, Friedman S, Abar O T, Yee L, Chokkalingam A P, Schrodi S J, Chan J, Catanese J J, Leong D U, Ross D, Hu X, Monto A, McAllister L B, Broder S, White T, Sninsky J J, Wright T L (2006) Identification of two gene variants associated with risk of advanced fibrosis in patients with chronic hepatitis C. Gastroenterology 130:1679-1687

55. Li Y, Grupe A, Rowland C, Nowotny P, Kauwe J S, Smemo S, Hinrichs A, Tacey K, Toombs T A, Kwok S, Catanese J, White T J, Maxwell T J, Hollingworth P, Abraham R, Rubinsztein D C, Brayne C, Wavrant-De Vrieze F, Hardy J, O'donovan M, Lovestone S, Morris J C, Thal L J, Owen M, Williams J, Goate A (2006) DAPK1 variants are associated with Alzheimer's disease and allele-specific expression. Hum Mol Genet 15:2560-2568

56. Veal C D, Clough R L, Barber R C, Mason S, Tillman D, Ferry B, Jones A B, Ameen M, Balendran N, Powis S H, Burden A D, Barker J N, Trembath R C (2001) Identification of a novel psoriasis susceptibility locus at 1p and evidence of epistasis between PSORS1 and candidate loci. J Med Genet 38:7-13

57. Yip S Y (1984) The prevalence of psoriasis in the Mongoloid race. J Am Acad Dermatol 10:965-968

58. Morahan G, Huang D, Ymer S I, Cancilla M R, Stephen K, Dabadghao P, Werther G, Tait B D, Harrison L C, Colman P G. (2001) Linkage disequilibrium of a type 1 diabetes susceptibility locus with a regulatory IL12B allele. Nat Genet 27:218-221

59. Randolph A G, Lange C, Silverman E K, Lazarus R, Silverman E S, Raby B, Brown A, Ozonoff A, Richter B, Weiss S T. (2004) The IL12B gene is associated with asthma. Am J Hum Genet 75:709-715

60. Mueller T, Mas-Marques A, Sarrazin C, Wiese M, Halangk J, Witt H, Ahlenstiel G, Spengler U, Goebel U, Wiedenmann B, Schreier E, Berg T. (2004) Influence of interleukin 12B (IL12B) polymorphisms on spontaneous and treatment-induced recovery from hepatitis C virus infection. J Hepatol 41:652-658

61. Seegers D, Zwiers A, Strober W, Pena A S, Bouma G (2002) A TaqI polymorphism in the 3'UTR of the IL-12 p40 gene correlates with increased IL-12 secretion. Genes Immun 3:419-423

62. Zwiers A, Seegers D, Heijmans R, Koch A, Hampe J, Nikolaus S, Pena A S, Schreiber S, Bouma G. (2004) Definition of polymorphisms and haplotypes in the interleukin-12B gene: association with IL-12 production but not with Crohn's disease. Genes Immun 5:675-677

63. Sanchez E, Morales S, Paco L, Lopez-Nevot M A, Hidalgo C, Jimenez-Alonso J, Torres B, Gonzalez-Gay M A, Callejas J L, Ortego-Centeno N, Sanchez-Roman J, Gonzalez-Escribano M F, Martin J (2005) Interleukin 12 (IL12B), interleukin 12 receptor (IL12RB1) and interleukin 23 (IL23A) gene polymorphism in systemic lupus erythematosus. Rheumatology 44:1136-1139.

64. Stanilova S, Miteva L (2005) Taq-I polymorphism in 3'UTR of the IL-12B and association with IL-12p40 production from human PBMC. Genes Immun 6:364-366

65. Hong K, Chu A, Ludviksson B R, Berg E L, Ehrhardt R O (1999) IL-12, independently of IFN-γ, plays a crucial role in the pathogenesis of a murine psoriasis-like skin disorder. J Immunol 162:7480-7491

66. Winterfield L S, Menter A, Gordon K, Gottlieb, A (2005) Psoriasis treatment: current and emerging directed therapies. Ann Rheum Dis 64 Suppl 2, ii87-90

67. Kauffinan C L, Aria N, Toichi E, McCormick T S, Cooper K D, Gottlieb A B, Everitt D E, Frederick B, Zhu Y, Graham M A, Pendley C E, Mascelli M A (2004) A phase I study evaluating the safety, pharmacokinetics, and clinical response of a human IL-12 p40 antibody in subjects with plaque psoriasis. J Invest Dermatol 123:1037-1044

68. Mannon P J, Fuss I J, Mayer L, Elson C O, Sandbom W J, Present D, Dolin B, Goodman N, Groden C, Hornung R L, Quezado M, Yang Z, Neurath M F, Salfeld J, Veldman G M, Schwertschlag U, Strober W; Anti-IL-12 Crohn's Disease Study Group (2004) Anti-interleukin-12 antibody for active Crohn's disease. N Engl J Med 351:2069-2079

69. Hunter C A (2005) New IL-12-family members: IL-23 and IL-27, cytokines with divergent functions. Nat Rev Immunol 5:521-31

70. Bowman E P, Chackerian A A, Cua D J (2006) Rationale and safety of anti-interleukin-23 and anti-interleukin-17A therapy. Curr Opin Infect Dis 19:245-252

71. Lee E, Trepicchio W L, Oestreicher J L, Pittman D, Wang F, Chamian F, Dhodapkar M, Krueger J G (2004) Increased expression of interleukin 23 p19 and p40 in lesional skin of patients with psoriasis vulgaris. J Exp Med 199:125-130

72. Piskin G, Sylva-Steenland R M, Bos J D, Teunissen M B (2006) In vitro and in situ expression of IL-23 by keratinocytes in healthy skin and psoriasis lesions: enhanced expression in psoriatic skin. J Immunol 176:1908-1915

73. Kopp T, Lenz P, Bello-Femandez C, Kastelein R A, Kupper T S, Stingl G. (2003) IL-23 production by cosecretion of endogenous p19 and transgenic p40 in keratin 14/p40 transgenic mice: evidence for enhanced cutaneous immunity. J Immunol 170:5438-5444

Example Two

Statistical Analysis of IL12B SNPs Associated with Psoriasis

As described above in Example One, a multi-tiered, case-control association study using a collection of over 25,000 gene-centric SNPs, identified association between a 3'UTR SNP in IL12B, rs3212227, and psoriasis risk (allelic $P_{comb}=7.85 \times 10^{-10}$) in three independent sample sets (Cargill et al (2007) *AJHG* 80(2):273-90, incorporated herein by reference). To determine whether any other SNPs in this gene region were associated with psoriasis a combination of tag SNPs (N=27), which had the highest average power to detect disease-associated variants under a conservative disease model, and functional SNPs (N=3) was used to genotype the three sample sets. This identified a second risk allele, rs6887695 (allelic $P_{comb}=4.08 \times 10^{-8}$), located approximately 60 kb upstream of the IL12B coding region that exhibited association with psoriasis after adjustment for rs3212227. Together these two SNPs marked a common IL12B risk haplotype ($OR_{common}$ 1.40, $P_{comb}=8.11 \times 10^{-9}$) and a less frequent protective haplotype ($OR_{common}$ 0.58, $P_{comb}=5.65 \times 10^{-12}$), which were statistically significant in all three studies.

As a follow-up to the study described in Example One, 20 additional SNPs were selected for genotyping in the three psoriasis case-control sample sets and the data for all 51 IL12B-region SNPs is reported herein in Example Two.

All individuals in the sample sets included in this study were over the age of 18 at the time they were enrolled into the sample collections. In addition, none of the subjects had undergone a bone marrow transplant. All protocols were approved by national and/or local institutional review boards, and informed written consent was obtained from all subjects. A detailed description can be found in Cargill et al (2007) *AJHG* 80(2):273-90.

SNP Selection

Twenty SNPs were selected for follow-up genotyping. All 20 of these SNPs were between positions (158537541-158812974)—covering 250 kbp—and were preferentially selected to cover the IL12B coding region. These new SNPs were also chosen so that they (i) covered a range of $r^2$ values with the previously-described associated markers rs3212227 and rs6887695, concentrating on SNPs with higher levels of L D, (ii) were likely to be in evolutionarily-conserved regions (UCSC website) and (iii) had frequencies greater than 1% in whites of European descent. Lastly, redundancy within the new set of SNPs was reduced by eliminating some SNPs in extremely high LD (>0.97) with other SNPs selected.

Single Marker Analyses

The single marker results for all 51 SNPs are shown in Table 6, including the data for the 20 new SNPs. An exact test of HWE of the genotype data for these 51 SNPs, with the analysis performed separately for cases and controls in each sample set, identified only one instance where a marker was not in HWE at the P<0.01 significance level (rs7721001 in the discovery controls, P=0.005). Single marker analyses showed that 9 of the 51 SNPs genotyped in this study in addition to the two original SNPs, rs3212227 and rs6887695, were associated with psoriasis risk at $P<10^{-6}$ (Table 6). The original 3'UTR SNP, rs3212227, however, remained the most significant marker across all three studies with the minor C allele being highly protective ($OR_{common}$ 0.64, $P_{comb}=1.66E \times 10^{-9}$).

LD Patterns

The LD patterns in this region were next examined by calculating the pairwise $r^2$ values between all 51 markers. This was done separately for the cases and controls in each sample set. Six of the eleven highly significant SNPs ($p<10^{-6}$) (rs2082412, rs7730390, rs3213093, rs3212220, rs3212217 and the original IL12B 3'UTR SNP rs3212227), which are located within a 37 kb region that extends from intron 1 to the 3' intergenic region of IL12B, are highly correlated with each other in the cases and controls of all three sample sets ($r^2>0.97$) (referred to as Group 1). Three of the eleven SNPs, rs6861600, rs7704367 and rs6887695 (the other significant independently associated SNP), which are located within a 3 kb region approximately 60 kb 5' of the IL12B gene, are highly correlated with each other in the cases and controls of all three sample sets ($r^2>0.98$) (referred to as Group 2). The LD patterns of the tenth SNP, rs6894567, located in intron 1 of IL12B, show that it is reasonably correlated with rs3212227 ($r^2\sim 0.75$-$0.83$) and modestly correlated with rs6887695 ($r^2\sim 0.22$-$0.36$). The eleventh significant SNP, rs7709212, located 5' of IL12B and hypothesized to regulate IL12B expression levels, is modestly correlated with rs3212227 ($r^2\sim 0.28$-$0.40$) and reasonably correlated with rs6887695 ($r^2\sim 0.70$-$0.79$).

Conditional Analyses to Identify Independent Risk Alleles

To explore the possibility that SNPs aside from rs3212227 independently associate with psoriasis, a logistic regression analysis was performed across each of the three studies adjusting for rs3212227. P-values were combined across the three independent studies using the Fisher's combined P-value method and plotted by position. The combined analysis points to a region 5' to IL12B including SNPs rs6887695, rs1422878 and rs4921496 (P-value adjusted for rs3212227=0.028, P=0.0009, P=0.0013; respectively).

Conclusions

A thorough genetic interrogation and subsequent analysis of the IL12B-gene region reveals that the 3'UTR SNP rs3212227 is highly statistically significantly associated with psoriasis.

A combined analysis across the three studies, adjusting for rs3212227, indicates that other SNPs 5' of the coding region including rs6887695, rs1422878 and rs4921496, may contribute to psoriasis risk independently of rs3212227.

These data indicate that the set of SNPs in strong LD with rs3212227 (Group 1) are primary drivers of the association at the IL12B-region with psoriasis.

Example Three

Statistical Analysis of IL23R SNPs Associated with Psoriasis

As described above in Example One, a multi-tiered, case-control association design, scanning over 25,000 gene-centric SNPs, identified two psoriasis susceptibility genes: IL12B and IL23R (Cargill et al (2007) *AJHG* 80(2):273-90, incorporated herein by reference). To refine the initial association results and further investigate the region involved in psoriasis risk, the genetic analysis was extended by resequencing the IL23R gene in 96 psoriatic individuals. Twelve novel IL23R SNPs were discovered including one missense, two synonymous and three 3' UTR SNPs. Using a series of selection criteria, 58 additional IL23R-linked SNPs were identified which were genotyped in the three independent, white North American sample sets (>2800 individuals in toto). Single marker and preliminary haplotype analyses have been performed on the full set of interrogated SNPs. A sliding window of haplotype association demonstrates co-localization of psoriasis susceptibility within the boundaries of IL23R across all sample sets, thereby decreasing the likelihood that neighboring genes, particularly IL12RB2 which lies directly adjacent to IL23R, are driving the association of this region with psoriasis. The IL23R genetic variants provided herein may be associated with variability between different individuals in their response to psoriasis therapy and may be used to determine the most effective dosage of therapy for a particular individual.

SNP Selection

A multifaceted approach was carried out to identify SNPs to genotype individually in a fine-scale mapping effort in the IL23R region. A 336 kbp region was selected across a portion of C1orf141 through SERBP1. SNPs in moderate to high LD ($r^2>0.20$) with the two originally-identified missense SNPs, rs7530511 and rs11209026, were initially selected and reduced so that those pairs within this group in extremely high LD ($r^2>0.97$) were represented by one or two SNPs. Next, the tagging SNP program Redigo (Hu et al (2004) *Hum Hered* 57:156-170) was run to select a set of tagging SNPs among those in weak LD ($r^2<0.20$) with the original two SNPs. Further, any SNPs with putative function annotation were selected to be genotyped. In all, 61 SNPs were identified to cover the IL23R region.

Single SNP Analyses

The allelic association P-values were plotted as a function of position for the 61 SNPs selected to interrogate the IL23R region. The peak of psoriasis association occurs over the IL23R coding region.

Genotype Analyses

Six individual SNPs with combined P-values below 0.05 are presented in detail showing genotype frequencies in cases and controls across the three sample sets (Table 19). Notably, the Q381R SNP (rs11209026) yielded the most significant combined association results.

Linkage Disequilibrium

Pairwise linkage disequilibrium was calculated across cases and controls combined as an exploratory analysis to better understand the detailed structure in the IL23R region (Abecasis et al (2000) *Bioinformatics* 16:182-183). The correlation statistic $r^2$ was employed. As much of the association signal was being driven by rs11209026, the decay of rs11209026-LD was elucidated in a positional fashion. A single SNP attained a $r^2$ value greater than 0.20 in the sample sets: rs11465804, located in an IL23R intron. A genotypic-based squared correlation coefficient was calculated between the two sites: Discovery cases $g^2=0.902$, Discovery controls $g^2=0.888$, Repl 1 cases $g^2=0.705$, Repl 1 controls $g^2=0.870$, Repl 2 cases $g^2=0.914$, and Repl 2 controls $g^2=0.872$. Two-SNP analyses of rs11209026 and rs11465804 indicate that recombinants between the two SNPs are reasonably rare in the samples.

Haplotype Analyses

Using a sliding window of haplotype association on 3 adjacent SNPs, two neighboring windows composed of rs10789229, rs10889671, rs11209026 and rs10889674 were identified that yielded the peak global association with psoriasis when analyses are combined across the three independent sample sets (window 1 combined P-value=1.28E-04 and window 2 combined P-value=6.42E-05). Both windows were significant (P<0.05) in each of the three studies. These four SNPs reside within a 12 kbp region within IL23R. Table 21 provides IL23R region sliding window haplotype association 3-SNP windows.

SNPs significantly associated using a Fisher's combined P-value across all three studies (6 SNPs from Table 19) were examined and partitioned into three groups on the basis of LD structure and significance. Group1: rs7530511, rs10889671, rs1857292; Group2: rs11465804 and rs11209026; Group3: rs10889674. One representative SNP from each group was used in a haplotype analysis where phase was estimated through a pseudo-Gibbs sampling algorithm (SNPAnalyzer program). See Yoo et al (2005) *Nucleic Acids Res* 33:W483-W488. Haplotypes segregating at rs7530511-rs11209026-rs10889674 were then evaluated for statistical association. One psoriasis-predisposing haplotype (C-G-G), one neutral haplotype (C-G-T) and two protective haplotypes (T-G-T and C-A-T) were found (Table 20).

Conclusions

Fine-scale mapping of the IL23R region across three independent psoriasis case-control sample sets shows variants segregating at IL23R that are significantly associated with disease.

As with several other inflammation disease susceptibility genes exhibiting pleiotropy, variants at IL23R now appear to confer risk/protection for psoriasis and IBD. A novel SNP-selection procedure to fine-scale map regions with initial association data is discussed herein. Single marker analysis produces little evidence that the IL23R-neighboring gene IL12RB2 (also a functional candidate) is generating the patterns of psoriasis-association in the region. Three-SNP haplotype sliding window analysis yields a peak association of 6.42E-05 located at IL23R with the adjacent SNPs rs10889671-rs11209026-rs10889674. Additional haplotype analyses with representative SNPs derived from LD groups, demonstrate that haplotypes segregating at rs7530511-rs11209026-rs10889674 (L310P-Q381R—putative transcription factor binding site) generate susceptible, neutral and protective effects with regard to psoriasis.

Example Four

Additional LD SNPs Associated with Psoriasis

Another investigation was conducted to identify SNPs in linkage disequilibrium (LD) with certain "interrogated SNPs" which have been found to be associated with psoriasis, as shown in the tables. The interrogated SNPs, which are shown in column 1 (which indicates the hCV identification numbers of each interrogated SNP) and column 2 (which indicates the public rs identification numbers of each interrogated SNP) of Table 4. The methodology is described earlier in the instant application. To summarize briefly, the power threshold (T) was set at an appropriate level, such as 51%, for detecting disease association using LD markers. This power threshold is based on equation (31) above, which incorporates allele frequency data from previous disease association studies, the predicted error rate for not detecting truly disease-associated markers, and a significance level of 0.05. Using this power calculation and the sample size, for each interrogated SNP a threshold level of LD, or $r^2$ value, was derived ($r_T^2$, equations (32) and (33) above). The threshold value $r_T^2$ is the minimum value of linkage disequilibrium between the interrogated SNP and its LD SNPs possible such that the non-interrogated SNP still retains a power greater or equal to T for detecting disease-association.

Based on the above methodology, LD SNPs were found for the interrogated SNPs. Several exemplary LD SNPs for the interrogated SNPs are listed in Table 4; each LD SNP is associated with its respective interrogated SNP. Also shown are the public SNP IDs (rs numbers) for the interrogated and LD SNPs, when available, and the threshold $r^2$ value and the power used to determine this, and the $r^2$ value of linkage disequilibrium between the interrogated SNP and its matching LD SNP. As an example in Table 4, the interrogated, psoriasis-associated SNP rs6887695 (hCV1994992) was calculated to be in LD with rs11135059 (hCV11269323) at an $r^2$ value of 0.96248, based on a 51% power calculation, thus establishing the latter as a marker associated with psoriasis as well.

All publications and patents cited in this specification are herein incorporated by reference in their entirety. Various modifications and variations of the described compositions, methods and systems of the invention will be apparent to those skilled in the art without departing from the scope and spirit of the invention. Although the invention has been described in connection with specific preferred embodiments and certain working examples, it should be understood that the invention as claimed should not be unduly limited to such specific embodiments. Indeed, various modifications of the above-described modes for carrying out the invention that are obvious to those skilled in the field of molecular biology, genetics and related fields are intended to be within the scope of the following claims.

TABLE 1

Transcript SNP info and associated gene/protein information

| | |
|---|---|
| Gene Number: | 1 |
| Celera Gene: | hCG16056 - 84000313410292 |
| Celera Transcript: | hCT7086 - 84000313410293 |
| Public Transcript Accession: | NM_002187 |
| Celera Protein: | hCP35440 - 197000069447233 |
| Public Protein Accession: | NP_002178 |
| Gene Symbol: | IL12B |
| Protein Name: | interleukin 12B (natural killer cell stimulatory factor 2, cytotoxic lymphocyte maturation factor 2, p40) |
| Celera Genomic Axis: | GA_x5YUV32VUFE (16577243 . . . 16609245) |
| Chromosome: | 5 |
| OMIM NUMBER: | 161561 |
| OMIM Information: | BCG and salmonella infection, disseminated, 209950 (1); {Asthma,/susceptibility to} 600807 (3) |
| Transcript Sequence (SEQ ID NO: 1): | |
| Protein Sequence (SEQ ID NO: 4): | |

SNP Information

Context (SEQ ID NO: 7):
AAGACACAACGGAATAGACCCAAAAAGATAATTTCTATCTGATTTGCTTT
AAAACGTTTTTTTAGGATCACAATGATATCTTTGCTGTATTTGTATAGTT
MGATGCTAAATGCTCATTGAAACAATCAGCTAATTTATGTATAGATTTTC
CAGCTCTCAAGTTGCCATGGGCCTTCATGCTATTTAAATATTTAAGTAAT
T

| | |
|---|---|
| Celera SNP ID: | hCV2084293 |
| Public SNP ID: | rs3212227 |
| SNP in Transcript Sequence SEQ ID NO: | 1 |
| SNP Position Transcript: | 1148 |
| SNP Source: | dbSNP; Celera; HapMap; HGBASE |
| Population (Allele, | caucasian (A, 93|C, 27) |

TABLE 1-continued

Transcript SNP info and associated gene/protein information

Count):
SNP Type: UTR3

Context
(SEQ ID NO: 8):
TGTCTGGAAGGCAAAAAGATCTTAAGATTCAAGAGAGAGGACAAGTAGTT
ATGGCTAAGGACATGAAATTGTCAGAATGGCAGGTGGCTTCTTAACAGCC
MTGTGAGAAGCAGACAGATGCAAAGAAAATCTGGAATCCCTTTCTCATTA
GCATGAATGAACCTGATACACAATTATGACCAGAAAATATGGCTCCATGA
A

| | |
|---|---|
| Celera SNP ID: | hCV7537839 |
| Public SNP ID: | rs1368439 |
| SNP in Transcript Sequence | SEQ ID NO: 1 |
| SNP Position Transcript: | 2084 |
| SNP Source: | dbSNP; Celera; HapMap; HGBASE; |
| Population (Allele, Count): | caucasian (C, 26|A, 94) |
| SNP Type: | UTR3 |
| Gene Number: | 2 |
| Celera Gene: | hCG1807923 - 30000023016764 |
| Celera Transcript: | hCT1847183 - 30000023016767 |
| Public Transcript Accession: | |
| Celera Protein: | hCP1738390 - 30000023016751 |
| Public Protein Accession: | |
| Gene Symbol: | IL23R |
| Protein Name: | interleukin-23 receptor |
| Celera Genomic Axis: | GA_x5YUV32W802 (15859517 . . . 15972828) |
| Chromosome: | 1 |
| OMIM NUMBER: | 607562 |
| OMIM Information: | |

Transcript Sequence
(SEQ ID NO: 2):

Protein Sequence
(SEQ ID NO: 5):

SNP Information

Context
(SEQ ID NO: 9):
TCTGACAACAGAGGAGACATTGGACTTTTATTGGGAATGATCGTCTTTGC
TGTTATGTTGTCAATTCTTTCTTTGATTGGGATATTTAACAGATCATTCC
RAACTGGGATTAAAAGAAGGATCTTATTGTTAATACCAAAGTGGCTTTAT
GAAGATATTCCTAATATGAAAAACAGCAATGTTGTGAAAATGCTACAGGA
A

| | |
|---|---|
| Celera SNP ID: | hCV1272298 |
| Public SNP ID: | rs11209026 |
| SNP in Transcript Sequence | SEQ ID NO: 2 |
| SNP Position Transcript: | 428 |
| SNP Source: | dbSNP; Celera; HapMap |
| Population (Allele, Count): | caucasian (G, 112|A, 8) |
| SNP Type: | Missense Mutation |
| Protein Coding: | SEQ ID NO: 5, at position 143, (R, CGA) (Q, CAA) |

Context
(SEQ ID NO: 10):
GTGCAACAGTCAGAATTCTACTTGGAGCCAAACATTAAGTACGTATTTCA
AGTGAGATGTCAAGAAACAGGCAAAAGGTACTGGCAGCCTTGGAGTTCAC
YGTTTTTTCATAAAACACCTGAAACAGTTCCCCAGGTCACATCAAAAGCA
TTCCAACATGACACATGGAATTCTGGGCTAACAGTTGCTTCCATCTCTAC
A

| | |
|---|---|
| Celera SNP ID: | hCV2990018 |
| Public SNP ID: | rs7530511 |
| SNP in Transcript Sequence | SEQ ID NO: 2 |
| SNP Position Transcript: | 215 |
| SNP Source: | dbSNP; Celera; HapMap |
| Population (Allele, Count): | caucasian (T, 15|C, 105) |
| SNP Type: | Missense Mutation |
| Protein Coding: | SEQ ID NO: 5, at position 72, (P, CCG) (L, CTG) |
| Gene Number: | 2 |
| Cetera Gene: | hCG1807923 - 30000023016764 |
| Cetera Transcript: | hCT2349254 - 30000023016772 |
| Public Transcript Accession: | NM_144701 |
| Cetera Protein: | hCP1914504 - 30000023016752 |
| Public Protein Accession: | NP_653302 |
| Gene Symbol: | IL23R |
| Protein Name: | interleukin-23 receptor |
| Cetera Genomic Axis: | GA_x5YUV32W802 (15859517 . . . 15972828) |
| Chromosome: | 1 |
| OMIM NUMBER: | 607562 |
| OMIM Information: | |

Transcript Sequence
(SEQ ID NO: 3):

Protein Sequence
(SEQ ID NO: 6):

SNP Information

Context
(SEQ ID NO: 11):
TCTGACAACAGAGGAGACATTGGACTTTTATTGGGAATGATCGTCTTTGC
TGTTATGTTGTCAATTCTTTCTTTGATTGGGATATTTAACAGATCATTCC
RAACTGGGATTAAAAGAAGGATCTTATTGTTAATACCAAAGTGGCTTTAT
GAAGATATTCCTAATATGAAAAACAGCAATGTTGTGAAAATGCTACAGGA
A

| | |
|---|---|
| Cetera SNP ID: | hCV1272298 |
| Public SNP ID: | rs11209026 |
| SNP in Transcript Sequence | SEQ ID NO: 3 |
| SNP Position Transcript: | 1227 |
| SNP Source: | dbSNP; Cetera; HapMap |
| Population (Allele, Count): | caucasian (G, 112|A, 8) |
| SNP Type: | Missense Mutation |
| Protein Coding: | SEQ ID NO: 6, at position 381, (R, CGA) (Q, CAA) |

Context
(SEQ ID NO: 12):
GTGCAACAGTCAGAATTCTACTTGGAGCCAAACATTAAGTACGTATTTCA
AGTGAGATGTCAAGAAACAGGCAAAAGGTACTGGCAGCCTTGGAGTTCAC
YGTTTTTTCATAAAACACCTGAAACAGTTCCCCAGGTCACATCAAAAGCA
TTCCAACATGACACATGGAATTCTGGGCTAACAGTTGCTTCCATCTCTAC
A

| | |
|---|---|
| Celera SNP ID: | hCV2990018 |
| Public SNP ID: | rs7530511 |
| SNP in Transcript Sequence | SEQ ID NO: 3 |
| SNP Position Transcript: | 1014 |
| SNP Source: | dbSNP; Celera; HapMap |

TABLE 1-continued

Transcript SNP info and associated gene/protein information

| | |
|---|---|
| Population (Allele, Count): | caucasian (T, 15\|C, 105) |
| SNP Type: | Missense Mutation |
| Protein Coding: | SEQ ID NO: 6, at position 310, (P, CCG) (L, CTG) |

TABLE 2

Genomic SNP info and associated gene information

| | |
|---|---|
| Gene Number: | 1 |
| Celera Gene: | hCG16056 - 84000313410292 |
| Gene Symbol: | IL12B |
| Protein Name: | interleukin 12B (natural killer cell stimulatory factor 2, cytotoxic lymphocyte maturation factor 2, p40) |
| Celera Genomic Axis: | GA_x5YUV32VUFE (16577243 . . . 16609245) |
| Chromosome: | 5 |
| OMIM NUMBER: | 161561 |
| OMIM Information: | BCG and salmonella infection, disseminated, 209950 (1); {Asthma,/susceptibility to}, 600807 (3) |

Genomic Sequence
(SEQ ID NO: 13):

SNP Information

Context
(SEQ ID NO: 24):
CTGTGTGCCCAGCACTTCCTCTGCATGCCTCAGATGCATTTGACAATCTC
AGGTGAACTGCACTTCAGGGTCAAGGGAACCCCGGCCATGGTTCTAAGAA
RCAACTCCCATTTTAGTATCACCTACATTTGAAACCACAGAGCACTGTCC
AGGAGAGGTGATGGTGGTGGGTCTCCTCCTTTGGCTCTCTGGCCCATCAG
C

| | |
|---|---|
| Celera SNP ID: | hCV1992693 |
| Public SNP ID: | rs1433048 |
| SNP in Genomic Sequence: | SEQ ID NO: 13 |
| SNP Position Genomic: | 24055 |
| SNP Source: | dbSNP; Celera; HapMap; ABI_Val; HGBASE |
| Population (Allele, Count): | caucasian (G, 21\|A, 99) |
| SNP Type: | INTRON |

Context
(SEQ ID NO: 25):
AATTACTTAAATATTTAAATAGCATGAAGGCCCATGGCAACTTGAGAGCT
GGAAAATCTATACATAAATTAGCTGATTGTTTCAATGAGCATTTAGCATC
KAACTATACAAATACAGCAAAGATATCATTGTGATCCTAAAAAAACGTTT
TAAAGCAAATCAGATAGAAATTATCTTTTTGGGTCTATTCCGTTGTGTCT
T

| | |
|---|---|
| Celera SNP ID: | hCV2084293 |
| Public SNP ID: | rs3212227 |
| SNP in Genomic Sequence: | SEQ ID NO: 13 |
| SNP Position Genomic: | 11160 |
| SNP Source: | dbSNP; Celera; HapMap; HGBASE |
| Population (Allele, Count): | caucasian (T, 93\|G, 27) |
| SNP Type: | UTR3; INTRON |

Context
(SEQ ID NO: 26):
GGCTTTGTCCAGTGATTTTAAAAGTGGGGTGAAAGGAGTCTGGGCGGTA
CAAAAGGGCCTCTGGAACCTTGCAACAGGCAAAGGAATTCTGCTGTAAGG

TABLE 2-continued

Genomic SNP info and associated gene information

YGAGGAAGCTGGGAAGCCAATATCTTAGCCTCTATAAGTGTAGACATTCT
GTTTAGTAAAATAATTTTATAATATCTGGAACAGCCAGGAGCTATCCATT
T

| | |
|---|---|
| Celera SNP ID: | hCV2084296 |
| Public SNP ID: | rs2853696 |
| SNP in Genomic Sequence: | SEQ ID NO: 13 |
| SNP Position Genomic: | 12870 |
| SNP Source: | dbSNP; Celera; HapMap; ABI_Val; HGBASE |
| Population (Allele, Count): | caucasian (T, 26\|C, 94) |
| SNP Type: | INTRON |

Context
(SEQ ID NO: 27):
CCCCTCTGACTCTCTCTGCAGAGAGTGTAGCAGCTCCGCACGTCACCCCT
TGGGGGTCAGAAGAGCTGAAGTCAAAGACAGAAATTAGCCTGTGTTACAC
MTTGGGGAGAGAGTTCCTAGTGATTGTAGCCAGTAAGGCAGGTAAGGCCT
CAACTGTTGTCTGAGGACACAGTTTCTCCAACTGGGCTGATTTCTACCCA
G

| | |
|---|---|
| Celera SNP ID: | hCV2084297 |
| Public SNP ID: | rs919766 |
| SNP in Genomic Sequence: | SEQ ID NO: 13 |
| SNP Position Genomic: | 15774 |
| SNP Source: | dbSNP; Celera; HapMap; HGBASE |
| Population (Allele, Count): | caucasian (A, 110\|C, 10) |
| SNP Type: | INTRON |

Context
(SEQ ID NO: 28):
GTCTGCTTCAGGGCCCCTAAGATCTACGCCCTGGAGCTCTTGTTTTTATT
TTTGACTCAAGGTGCAATTTCAGCAAGTCATTTGTAGCTTTGAATTCTCC
KTTTATCCCTTTCTTTGGTGCTATGAGGCTTCAGGAAGCATGGCCAGGCA
ATTTGGATGAGTGGGTTCAAACACAGCAGAGACTATTCTCAGTTCCCAAT
A

| | |
|---|---|
| Celera SNP ID: | hCV2084298 |
| Public SNP ID: | rs2853694 |
| SNP in Genomic Sequence: | SEQ ID NO: 13 |
| SNP Position Genomic: | 17298 |
| SNP Source: | dbSNP; Celera; HapMap; HGBASE |
| Population (Allele, Count): | caucasian (G, 65\|T, 55) |
| SNP Type: | INTRON |

Context
(SEQ ID NO: 29):
TATCTGCCTTACATTTGACTGAGGATTAAATGAAAAAAAAAAAAGCACG
TAAAGTACTTAGCACAGTGTCTGCCACACAGTAAATTCGGTGTTAGTTAT
YGTTACTTATAGACTGAGGAGTCAGCCAACTGTACAGAGAAACTCTCTTA
ACAATTTTCCATGGATATTTAAGGATTTCGTTCCCTCTGTTTTAAATCAC
C

| | |
|---|---|
| Celera SNP ID: | hCV2084301 |
| Public SNP ID: | rs3213093 |
| SNP in Genomic Sequence: | SEQ ID NO: 13 |
| SNP Position Genomic: | 19189 |
| SNP Source: | dbSNP; Celera; HGBASE |
| Population (Allele, Count): | caucasian (C, 93\|T, 27) |
| SNP Type: | INTRON; REPEATS |

Context
(SEQ ID NO: 30):
TTCATGGAGCCATATTTTCTGGTCATAATTGTGTATCAGGTTCATTCATG
CTAATGAGAAAGGGATTCCAGATTTTCTTTGCATCGTCTGCTTCTCACA
KGGCTGTTAAGAAGCCACCTGCCATTCTGACAATTTCATGTCCTTAGCCA

TABLE 2-continued

Genomic SNP info and associated gene information

TAACTACTTGTCCTCTCTCTTGAATCTTAAGATCTTTTTGCCTTCCAGAC
A

| | |
|---|---|
| Celera SNP ID: | hCV7537839 |
| Public SNP ID: | rs1368439 |
| SNP in Genomic Sequence: | SEQ ID NO: 13 |
| SNP Position Genomic: | 10224 |
| SNP Source: | dbSNP; Celera; HapMap; HGBASE; |
| Population (Allele, Count): | caucasian (G, 26\|T, 94) |
| SNP Type: | UTR3; INTRON |

Context
(SEQ ID NO: 31):
GCAATGCTCAACTGTTTCAGTCAAATACCTTAAAAATGAGCATTCCTGGG
TTGGGTGACGGAATATTGACAAATTACAGCTTTGTCAGAACTGCTACTAA
STCTAGGCGGACCTTGCTATGTACTTTATTCCCTTATAAAGTTTGTGAGT
GGCAGAGACAGGCCTAGAAGTCAAGCCTTCTTGGACACTGCTCAGTGCTG
T

| | |
|---|---|
| Celera SNP ID: | hCV27471935 |
| Public SNP ID: | rs3212217 |
| SNP in Genomic Sequence: | SEQ ID NO: 13 |
| SNP Position Genomic: | 23340 |
| SNP Source: | dbSNP; HapMap; HGBASE |
| Population (Allele, Count): | caucasian (G, 93\|C, 27) |
| SNP Type: | INTRON |

Context
(SEQ ID NO: 32):
GCCTCTCTGAGGAGGTGACATTTAGCTGACACCAAAAGGAAAGATGTCAG
TTGTGTTAAGAGCAGAGGGAAGCATATGTGCGAAGCACCTGCTAGGAGCC
RTGATCTTTGTGTGGAGCAGTGCCAGGCCTACAGAGCCCAACCACACACC
CTAGCATGTCTCTGCCTCCTCTTATCTAGAAGACCTAATTGAGGAAGGAG
T

| | |
|---|---|
| Celera SNP ID: | hCV32389158 |
| Public SNP ID: | rs3213102 |
| SNP in Genomic Sequence: | SEQ ID NO: 13 |
| SNP Position Genomic: | 14806 |
| SNP Source: | dbSNP; HapMap; HGBASE |
| Population (Allele, Count): | caucasian (G, 116\|A, 2) |
| SNP Type: | INTRON |

Context
(SEQ ID NO: 33):
CTCTTATTTTAAGATGAGAAACTTAAAGCTTAGAGAAGGAATGTGACTT
TCTGGATCAACATCTAGCAGTTGTTTATTTAGTGCTTACTACATAAAGAG
MACTGGGCTAGAAGCAGTTGAGAGAGAAAAAAGGGCTTACCTGGATCCC
GCTTCCTAGGAGCAAATACTTTTACTCAATAAATATTTATTAAGTCAGTG
T

| | |
|---|---|
| Celera SNP ID: | hDV68553886 |
| Public SNP ID: | rs3212220 |
| SNP in Genomic Sequence: | SEQ ID NO: 13 |
| SNP Position Genomic: | 22405 |
| SNP Source: | dbSNP; HapMap; ABI_Val; HGBASE |
| Population (Allele, Count): | caucasian (C, 93\|A, 27) |
| SNP Type: | INTRON |

Context
(SEQ ID NO: 34):
AGATTGTGATTCAGATCTGGGATGGGGCTCAGGAACCTGCATTTTAACAA
TGGAGGTTCTAATGTGGTCATTGGCAGGTTGTTCTAATGTGGGGGCCACA
GCCTCTCTCGGAGACAGGCTGTACATGGCCAGCCAGCATTCTGGTAATAT

GAGCCAAATGCCCATTGACCTAATTTTGGAGAAGAGGTTTATCAACATGT
C

| | |
|---|---|
| Celera SNP ID: | hDV70663683 |
| Public SNP ID: | rs17860508 |
| SNP in Genomic Sequence: | SEQ ID NO: 13 |
| SNP Position Genomic: | 309920 |
| SNP Source: | CDX |
| Population (Allele, Count): | no_pop (G, -\|, -) |
| SNP Type: | INDEL; PROMOTER |

Context
(SEQ ID NO: 35):
ATAGCTTTTCATTTTTTAACTGGGGCCAAAGTTAGTTAATCCACAAGAAT
GGGGATCCCAGCTGTCATTTTGGTTGATATCACAACTGACGACCAAGACC
RTCACAAATATGGGAGCAAGTCTGATTTGTAACATTATTATAATTATGAA
TCCAATTACTTTAAGGAATGCACGAAAGGCTTTTTAAAAATTTCAATAGT
A

| | |
|---|---|
| Celera SNP ID: | hDV71045748 |
| Public SNP ID: | rs6894567 |
| SNP in Genomic Sequence: | SEQ ID NO: 13 |
| SNP Position Genomic: | 25178 |
| SNP Source: | dbSNP; HapMap |
| Population (Allele, Count): | caucasian (A, 94\|G, 26) |
| SNP Type: | INTRON |

Context
(SEQ ID NO: 36):
GCTTCCCAACACTGGTGCCAACATCAGCATGCCAATGACGCTTGGGTGGG
CATCTCTTTTTTAAGTTTTGTTTGTTACCTTTAATTAGAAAAGGGAGTTA
YTATTAAAGAATAAAAAGATATAGTCACAGATGGCATGGGTGGCACATGC
AAAGATCCCTAGTTTGAGGGCCAGGCAGACTTCTAGAACTGTGTGACTCT
G

| | |
|---|---|
| Celera SNP ID: | hCV3169809 |
| Public SNP ID: | rs730691 |
| SNP in Genomic Sequence: | SEQ ID NO: 13 |
| SNP Position Genomic: | 24437 |
| Related Interrogated SNP: | hCV2084293 (Power = .6) |
| Related Interrogated SNP: | hCV30449508 (Power = .6) |
| SNP Source: | dbSNP; Celera; HapMap; ABI_Val; HGBASE |
| Population (Allele, Count): | caucasian (T, 47\|C, 73) |
| SNP Type: | TRANSCRIPTION FACTOR BINDING SITE; INTRON |

Context
(SEQ ID NO: 37):
GAGAAACTTCCAGCACAATTTCAGTTTCATAGAGAATACGGCAGGGCACA
ATATTCAGCAGAGTAACATAGTGGTTAAAAGCTCAGGGTGTCGAGAACAA
YGAACCAAGACTGTCATCCTGTCTCCACTAACCAGCTGGGGGATTTGGAA
CAAGGTATTTCATTATCATGAGCCTCAGTTTCCTCATCTGTAAAATGATA
A

| | |
|---|---|
| Celera SNP ID: | hCV29927086 |
| Public SNP ID: | rs3213094 |
| SNP in Genomic Sequence: | SEQ ID NO: 13 |
| SNP Position Genomic: | 18979 |
| Related Interrogated SNP: | hCV2084293 (Power = .9) |
| Related Interrogated SNP: | hCV30449508 (Power = .8) |

TABLE 2-continued

Genomic SNP info and associated gene information

| | |
|---|---|
| SNP Source: | dbSNP; HapMap; HGBASE |
| Population (Allele, Count): | caucasian (C, 93\|T, 27) |
| SNP Type: | INTRON; REPEATS |
| | |
| Gene Number: | 2 |
| Celera Gene: | hCG1807923 - 30000023016764 |
| Gene Symbol: | IL23R |
| Protein Name: | interleukin-23 receptor |
| Celera Genomic Axis: | GA_x5YUV32W802 (15859517 . . . 15972828) |
| Chromosome: | 1 |
| OMIM NUMBER: | 607562 |
| OMIM Information: | |

Genomic Sequence (SEQ ID NO: 14):

SNP Information

Context (SEQ ID NO: 38):
TTAGACAACAGAGGAGACATTGGACTTTTATTGGGAATGATCGTCTTTGC
TGTTATGTTGTCAATTCTTTCTTTGATTGGGATATTTAACAGATCATTCC
RAACTGGGTAGGTTTTTGCAGAATTTCTGTTTTCTGATTTAGACTACATG
TATATGTATCACCAAAATTTAGTCATTTCAGTTGTTTACTAGAAAAATCT
G

| | |
|---|---|
| Celera SNP ID: | hCV1272298 |
| Public SNP ID: | rs11209026 |
| SNP in Genomic Sequence: | SEQ ID NO: 14 |
| SNP Position Genomic: | 83622 |
| SNP Source: | dbSNP; Celera; HapMap |
| Population (Allele, Count): | caucasian (G, 112\|A, 8) |
| SNP Type: | MISSENSE MUTATION; HUMAN-MOUSE SYNTENIC REGION |

Context (SEQ ID NO: 39):
AACCCGGTACCTCAGTTGGAAATGAAGAAATCGTTCGTCTTCTGCATCAT
TCACGCTGGGAGCTGTAGACTGGAGCTGTTCCTATTCAGCCATCTTGGCT
YGGGACCAGAGAACTTCGTATTTCTTACAGCACCTCCTAAGTGTTATGTT
TTGTTGCAGATCCGCCAGATATTCCTGATGAAGTAACCTGTGTCATTTAT
G

| | |
|---|---|
| Celera SNP ID: | hCV1272348 |
| Public SNP ID: | rs6687620 |
| SNP in Genomic Sequence: | SEQ ID NO: 14 |
| SNP Position Genomic: | 26292 |
| SNP Source: | dbSNP; Celera; HapMap |
| Population (Allele, Count): | caucasian (T, 14\|C, 104) |
| SNP Type: | TRANSCRIPTION FACTOR BINDING SITE; INTRON; REPEATS |

Context (SEQ ID NO: 40):
AATTGAACCCAGGCCACCACTGTGAAAGTAAAAAACTTTAGCTACTGAGC
TACAGTACTGGGTAGTCTCCATTGTGCTTCCCAGAAGGGCTCTAAAGTAC
KTAATTTTGAGCTTGCAAAAGCTTTTAACTACTCAACTTAATTTTTAGAG
CTAACTGTGACATGAACCCTAAAATTCCTGTTCCCTTGAAGGCAGAGACC
A

| | |
|---|---|
| Celera SNP ID: | hCV2720255 |
| Public SNP ID: | rs10889674 |
| SNP in Genomic Sequence: | SEQ ID NO: 14 |
| SNP Position Genomic: | 95192 |
| SNP Source: | dbSNP; Celera |

TABLE 2-continued

Genomic SNP info and associated gene information

| | |
|---|---|
| Population (Allele, Count): | caucasian (G, 43\|T, 77) |
| SNP Type: | TRANSCRIPTION FACTOR BINDING SITE; INTRON; REPEATS |

Context (SEQ ID NO: 41):
GTGCAACAGTCAGAATTCTACTTGGAGCCAAACATTAAGTACGTATTTCA
AGTGAGATGTCAAGAAACAGGCAAAAGGTACTGGCAGCCTTGGAGTTCAC
YGTTTTTTCATAAAACACCTGAAACAGGTGAGTGTACTTATATATTTTAT
TCTGTTGGGCTTTTCTTTATATATCTTTTCTGCTGAGCACAGTGGCTCAC
A

| | |
|---|---|
| Celera SNP ID: | hCV2990018 |
| Public SNP ID: | rs7530511 |
| SNP in Genomic Sequence: | SEQ ID NO: 14 |
| SNP Position Genomic: | 63217 |
| SNP Source: | dbSNP; Celera; HapMap |
| Population (Allele, Count): | caucasian (T, 15\|C, 105) |
| SNP Type: | MISSENSE MUTATION; HUMAN-MOUSE SYNTENIC REGION |

Context (SEQ ID NO: 42):
ACCCACTGACATCAGATACATGTAGCCCAACTTTCTCAAACAAAAGTTG
TTTCTGGGGTAGTTGTGCACTCTGGAAAAACAGTCACTCTGTGGCCTAA
RGTAAAGGTTAATTTTGCTTCCCCCCACCCTTTCTCCTTTGAGACCTTTG
CTTTGAGCAGAGTAAAGAGAATAGTAATTCTGGTATCAAATGAAGACTAA
T

| | |
|---|---|
| Celera SNP ID: | hCV31222825 |
| Public SNP ID: | rs10889671 |
| SNP in Genomic Sequence: | SEQ ID NO: 14 |
| SNP Position Genomic: | 83390 |
| SNP Source: | dbSNP; HapMap |
| Population (Allele, Count): | caucasian (A, 14\|G, 106) |
| SNP Type: | INTRON |

Context (SEQ ID NO: 43):
ATGACACATGGAATTCTGGGCTAACAGTTGCTTCCATCTCTACAGGGCAC
CTTACTTCTGGTAAGAAAATACAACTTAGGCTTTTTGAGTAGTCTTTTAG
KAATTGCCCATTTTAACCCATCATACTGAAAAAATCACATCAGGTGTTAA
GTTTCTGGACAATAAGATATGCCTTATGTCTTCCATAGGAAAATAATAGA
C

| | |
|---|---|
| Celera SNP ID: | hCV31222838 |
| Public SNP ID: | rs11465804 |
| SNP in Genomic Sequence: | SEQ ID NO: 14 |
| SNP Position Genomic: | 80190 |
| SNP Source: | dbSNP; HapMap |
| Population (Allele, Count): | caucasian (T, 111\|G, 9) |
| SNP Type: | INTRON |
| | |
| Gene Number: | 3 |
| Celera Gene: | hCG16057 - 84000313410212 |
| Gene Symbol: | FLJ31951 |
| Protein Name: | hypothetical protein FLJ31951 |
| Celera Genomic Axis: | GA_x5YUV32VUFE (16696263 . . . 16766296) |
| Chromosome: | 5 |
| OMIM NUMBER: | |
| OMIM Information: | |

TABLE 2-continued

Genomic SNP info and associated gene information

Genomic Sequence
(SEQ ID NO: 15):

SNP Information

Context
(SEQ ID NO: 44):
CATCCTGGGCCACACGCAGCCCAGGAGTTGGACAAGCTTAGTCTACAATT
TCAAAGAAGTAACTTGCTGAGGTAACATATTTACTAGGTAAGGAAACAAT
YTGTATCAAGTCTGATTCTAAAGTTAATTTTCCTTTCTACTAACCATGCT
GCCTACCTAAGTGGAATGAACTAGATTGTGAAAACATGGATTCAAGTTAA
A

| | |
|---|---|
| Celera SNP ID: | hCV2081970 |
| Public SNP ID: | rs1897565 |
| SNP in Genomic Sequence: | SEQ ID NO: 15 |
| SNP Position Genomic: | 43496 |
| SNP Source: | dbSNP; Celera; HapMap; ABI_Val; HGBASE |
| Population (Allele, Count): | caucasian (T, 93\|C, 27) |
| SNP Type: | INTRON |

Context
(SEQ ID NO: 45):
GGTTACTAACAGCACTGAACATTATCAATAAGTATATGAAAACATTTGCA
ATTATTTGGTGAAATGTTCACATTCTTTGCCCATTTTTCTGCTAGAATAC
RTATCCTACTGCCTGATCGAAATAGTAATCCTTAGTCACATGATTGCATT
TTTCTAATATGTCCCTTGTCTTAATATTTTAAATAACTTTATTCTCTTAT
A

| | |
|---|---|
| Celera SNP ID: | hCV2081982 |
| Public SNP ID: | rs10076782 |
| SNP in Genomic Sequence: | SEQ ID NO: 15 |
| SNP Position Genomic: | 30195 |
| SNP Source: | dbSNP; Celera; HapMap |
| Population (Allele, Count): | caucasian (G, 93\|A, 27) |
| SNP Type: | INTRON |

Context
(SEQ ID NO: 46):
GAGCTAATGCTCCCAGCCCTTATATAGTATCTACATCTTAAGCTTTAATT
TTCAAAGAAGATTTCACTGATATAGATGAGGAATTCATTCAGGCAATCA
RTGCTTGTCCCTTACTATGCAGCTCCATGCTTCTATATAGTTATCTTTCC
TACACAATTGCTTATTAGTTGGTTTTTATGTGAAAGCATCTAATTTTACA
T

| | |
|---|---|
| Celera SNP ID: | hCV2081985 |
| Public SNP ID: | rs2043270 |
| SNP in Genomic Sequence: | SEQ ID NO: 15 |
| SNP Position Genomic: | 23213 |
| SNP Source: | dbSNP; Celera; HapMap; ABI_Val |
| Population (Allele, Count): | caucasian (A, 110\|G, 8) |
| SNP Type: | INTRON |

Context
(SEQ ID NO: 47):
GCCAAAATACTATTGACACAAACATGCATCACAACTCACTCTACAGCAT
TAACCAAACAATCCATAACAAACTAAGTTGACAATGCAAAGCTGTTAGT
KTTTAAATTATACACAGTAATTTGTAATTAAAAAGCAAGACCAGTGGCAT
TTAAAAATGATGACCTAGGCCAGGTGTAGTAGTGCACACCTATAATCCCA
G

| | |
|---|---|
| Celera SNP ID: | hCV30377542 |
| Public SNP ID: | rs6888950 |
| SNP in Genomic Sequence: | SEQ ID NO: 15 |
| SNP Position Genomic: | 49981 |
| SNP Source: | dbSNP |

TABLE 2-continued

Genomic SNP info and associated gene information

| | |
|---|---|
| Population (Allele, Count): | caucasian (T, 90\|G, 24) |
| SNP Type: | INTRON |
| Gene Number: | 4 |
| Celera Gene: | hCG2043024 - 208000044135268 |
| Gene Symbol: | EBF |
| Protein Name: | early B-cell factor |
| Celera Genomic Axis: | GA_x5YUV32VUFE (16804013 . . . 17223138) |
| Chromosome: | 5 |
| OMIM NUMBER: | 164343 |
| OMIM Information: | |

Genomic Sequence
(SEQ ID NO: 16):

SNP Information

Context
(SEQ ID NO: 48):
AAAGATGCAGGGTGTGCTGGGTATTTCTTAATTATTATTATTATTATTAT
CATATCTGCTAAATCACTCCTCGCTCGACATTTAATACAGGGTGATAGAC
MAAACACTGCTGATTTGGGGTTTGCCATAATGACTGACCTGAGCAAAGGC
TTTGTGTACAAAGTGGCTCCCCATTAAATAAGGGCTCTGTGGAACCAGCT
G

| | |
|---|---|
| Celera SNP ID: | hCV1992684 |
| Public SNP ID: | rs929779 |
| SNP in Genomic Sequence: | SEQ ID NO: 16 |
| SNP Position Genomic: | 370599 |
| SNP Source: | dbSNP; Celera; HapMap; ABI_Val; HGBASE |
| Population (Allele, Count): | caucasian (A, 47\|C, 73) |
| SNP Type: | INTRON |

Context
(SEQ ID NO: 49):
AGATTGTGATTCAGATCTGGGATGGGGCTCAGGAACCTGCATTTTAACAA
TGGAGGTTCTAATGTGGTCATTGGCAGGTTGTTCTAATGTGGGGGCCACA
GCCTCTCGGAGACAGGCTGTACATGGCCAGCCAGCATTCTGGTAATAT
GAGCCAAATGCCCATTGACCTAATTTTGGAGAAGAGGTTTATCAACATGT
C

| | |
|---|---|
| Celera SNP ID: | hDV70663683 |
| Public SNP ID: | rs17860508 |
| SNP in Genomic Sequence: | SEQ ID NO: 16 |
| SNP Position Genomic: | 303975 |
| SNP Source: | CDX |
| Population (Allele, Count): | no_pop (G, -\|, -) |
| SNP Type: | INDEL; PROMOTER |
| Gene Number: | 5 |
| Celera Gene: | hCG16059 - 84000313412783 |
| Gene Symbol: | UBLCP1 |
| Protein Name: | hypothetical protein MGC10067 |
| Celera Genomic Axis: | GA_x5YUV32VUFE (16618000 . . . 16660740) |
| Chromosome: | 5 |
| OMIM NUMBER: | |
| OMIM Information: | |

Genomic Sequence
(SEQ ID NO: 17):

SNP Information

Context
(SEQ ID NO: 50):
CCAATCCCCTACCAATACCAAAGGACAACTGTTACATCATAAGCTCTTAT
TACTTAACATTCATTATTCATTCATTCAGCATATATTTATTGAGCATCTA
YGTTAGCCAATATCATGCTAGGTTCTGAGAATGGAAAGGTGAATAAATTG

TABLE 2-continued

Genomic SNP info and associated gene information

TCTGTTCCTTAACAAAATTTACTGATATGGTTTGTCTTTGTGTCCCCACC
C

| | |
|---|---|
| Celera SNP ID: | hCV2081926 |
| Public SNP ID: | rs11744690 |
| SNP in Genomic Sequence: | SEQ ID NO: 17 |
| SNP Position Genomic: | 6853 |
| SNP Source: | dbSNP; Celera; HapMap; ABI_Val |
| Population (Allele, Count): | caucasian (T, 81|C, 39) |
| SNP Type: | INTERGENIC; UNKNOWN; REPEATS |

Context
(SEQ ID NO: 51):
CAAAGGCCCCCTTCCATTTCTCCTCTCCAGAGTGTTCCAGTAAGAACATC
CCCTTCTAGCTATTTCACACATGGACAACCAAGAAATAGTCATTTACGA
RCATTTTGCATTTGTACAATTTCACTCGTTATTTCTCCCCCAGTACCTAA
TGGGGGCTGCAGCGTGTACTCTGTTCGTGGTTAAATTCTGCTGCCAGAAG
T

| | |
|---|---|
| Celera SNP ID: | hCV2084270 |
| Public SNP ID: | rs2082412 |
| SNP in Genomic Sequence: | SEQ ID NO: 17 |
| SNP Position Genomic: | 37489 |
| SNP Source: | dbSNP; Celera; HGBASE |
| Population (Allele, Count): | caucasian (G, 93|A, 27) |
| SNP Type: | INTERGENIC; UNKNOWN |

Context
(SEQ ID NO: 52):
TCCCATGATGGTCAAGGAATAATTTTGGAGGAGACGTTTAACTTTAAAAA
AAAAAATACAATCATTAGTTTCATGTTTGTTTAAAAGAAACTTTGTTTTC
STAACCAACATTTGAGCTCCATTCATCTCTTGATGCAGGGAGAGATGTTA
TTGTAAATGTCTAGTTCTTTATGTTACTTTACAGTAGGGTTTTTAAAGA
C

| | |
|---|---|
| Celera SNP ID: | hCV7537756 |
| Public SNP ID: | rs1368437 |
| SNP in Genomic Sequence: | SEQ ID NO: 17 |
| SNP Position Genomic: | 26679 |
| SNP Source: | dbSNP; Celera; HapMap; ABI_Val; HGBASE |
| Population (Allele, Count): | caucasian (C, 112|G, 8) |
| SNP Type: | INTRON |

Context
(SEQ ID NO: 53):
GTCCACCCCCTGACAATGATGATGTTGTTAATGACTTTGATATTGAAGAT
GAAGTAGTTGAAGTAGAAAATAGGTAAGTGCTTTTCGCTTTAGAAGTAAT
SAGTTGTCATGTGAGAACAAGTGAATATTTTATCTAATTATATGTTTTCC
ATTAGGGAAGAAAACCTACTGAAAATTTCTCGCAGAGTGAAAGAGTACAA
A

| | |
|---|---|
| Celera SNP ID: | hCV2084255 |
| Public SNP ID: | rs3734104 |
| SNP in Genomic Sequence: | SEQ ID NO: 17 |
| SNP Position Genomic: | 17181 |
| Related Interrogated SNP: | hCV2084293 (Power = .6) |
| Related Interrogated SNP: | hCV30449508 (Power = .51) |
| SNP Source: | dbSNP; Celera; HapMap; HGBASE |
| Population (Allele, Count): | caucasian (G, 53|C, 67) |
| SNP Type: | INTRON |

Context
(SEQ ID NO: 54):
TGATATATATATATATGTGTGTGTGTATATATATTTTTTATTTTTTGG
CCAGAAAGTATTCTAGTTTATGGATGCATCATCATTTAACCATGTTATTC
MCTGTTGATTATAAATAATTTTTTATAAGGAATATTTTAAAAATTATGTT
TGATATTTTATCACTAGTTTTCTGTTTAGTTATATTCAAGCAGATTCTTG
A

| | |
|---|---|
| Celera SNP ID: | hCV284256 |
| Public SNP ID: | rs4147384 |
| SNP in Genomic Sequence: | SEQ ID NO: 17 |
| SNP Position Genomic: | 17768 |
| Related Interrogated SNP: | hCV2084293 (Power = .51) |
| SNP Source: | dbSNP; Celera; HapMap; HGBASE |
| Population (Allele, Count): | caucasian (C, 58|A, 56) |
| SNP Type: | INTRON |

Context
(SEQ ID NO: 55):
AGGGAATTGTGGGGTCAGAGCCCCCATACAGAGTCCCTACTGGGGCACTG
CCTAGTGGAGCTGAGAGAAGAGGGCCACCACCCTCCAGGCCCCAGAATGG
SAGATCTGACAACAGCTTGTACTGTGTGCCTGGAAAATCCACAGACACTC
AATGCCAGCCCGTGAAAGCAGCTGGGAGGGAGGGTTTACCTTGCAAAGCC
A

| | |
|---|---|
| Celera SNP ID: | hCV27883435 |
| Public SNP ID: | rs4921442 |
| SNP in Genomic Sequence: | SEQ ID NO: 17 |
| SNP Position Genomic: | 13800 |
| Related Interrogated SNP: | hCV2084293 (Power = .9) |
| Related Interrogated SNP: | hCV30449508 (Power = .8) |
| SNP Source: | dbSNP; HapMap |
| Population (Allele, Count): | no_pop (C, -|G, -) |
| SNP Type: | INTRON; REPEATS |

| | |
|---|---|
| Gene Number: | 6 |
| Celera Gene: | hCG1979566 - 84000313412803 |
| Gene Symbol: | |
| Protein Name: | |
| Celera Genomic Axis: | GA_x5YUV32VUFE (16570845 . . . 16613096) |
| Chromosome: | 5 |
| OMIM NUMBER: | |
| OMIM Information: | |

Genomic Sequence
(SEQ ID NO: 18):

SNP Information

Context
(SEQ ID NO: 56):
CTGTGTGCCCAGCACTTCCTCTGCATGCCTCAGATGCATTTGACAATCTC
AGGTGAACTGCACTTCAGGGTCAAGGGAACCCCGGCCATGGTTCTAAGAA
RCAACTCCATTTTAGTATCACCTACATTTGAAACCACAGAGCACTGTCC
AGGAGAGGTGATGGTGGTGGGTCTCCTCCTTTGGCTCTCTGGCCCATCAG
C

| | |
|---|---|
| Celera SNP ID: | hCV1992693 |
| Public SNP ID: | rs1433048 |
| SNP in Genomic Sequence: | SEQ ID NO: 18 |
| SNP Position | 27906 |

TABLE 2-continued

Genomic SNP info and associated gene information

Genomic:
SNP Source: dbSNP; Celera; HapMap; ABI_Val; HGBASE
Population (Allele, Count): caucasian (G, 21|A, 99)
SNP Type: INTRON Context
(SEQ ID NO: 57):
CCACTTCCAACATTGGGGATCAAATTTCAACATGAGATTTGGAGGGACAA
ATATGCAAACCATATCAGGTGTTGATGGTGAAGGGGTGCTGTGTTTCTTT
YTGGGGTATTGAAAATATTCCAGAATTTTATTGTGGTGATGGGAGCACAAC
TCTGTAAGTGTATAAAACCTGTTGAATTAGACACCTTAAAAGAGTCACTT
G Celera SNP ID: hCV2084281
Public SNP ID: rs7730390
SNP in Genomic Sequence: SEQ ID NO: 18
SNP Position Genomic: 2853
SNP Source: dbSNP; Celera; HapMap
Population (Allele, Count): caucasian (T, 91|C, 27)
SNP Type: INTERGENIC; UNKNOWN; REPEATS Context
(SEQ ID NO: 58):
AATTACTTAAATATTTAAATAGCATGAAGGCCCATGGCAACTTGAGAGCT
GGAAAATCTATACATAAATTAGCTGATTGTTTCAATGAGCATTTAGCATC
KAACTATACAAATACAGCAAAGATATCATTGTGATCCTAAAAAAACGTTT
TAAAGCAAATCAGATAGAAATTATCTTTTTGGGTCTATTCCGTTGTGTCT
T Celera SNP ID: hCV2084293
Public SNP ID: rs3212227
SNP in Genomic Sequence: SEQ ID NO: 18
SNP Position Genomic: 15011
SNP Source: dbSNP; Celera; HapMap; HGBASE
Population (Allele, Count): caucasian (T, 93|G, 27)
SNP Type: UTR3; INTRON Context
(SEQ ID NO: 59):
GGCTTTGTCCAGTGATTTTAAAAGTGGGGTGAAAGGAGTCTGGGGCGGTA
CAAAAGGGCCTCTGGAACCTTGCAACAGGCAAAGGAATTCTGCTGTAAGG
YGAGGAAGCTGGGAAGCCAATATCTTAGCCTCTATAAGTGTAGACATTCT
GTTTAGTAAAATAATTTTATAATATCTGGAACAGCCAGGAGCTATCCATT
T Celera SNP ID: hCV2084296
Public SNP ID: rs2853696
SNP in Genomic Sequence: SEQ ID NO: 18
SNP Position Genomic: 16721
SNP Source: dbSNP; Celera; HapMap; ABI_Val; HGBASE
Population (Allele, Count): caucasian (T, 26|C, 94)
SNP Type: INTRON Context
(SEQ ID NO: 60):
CCCCTCTGACTCTCTCTGCAGAGAGTGTAGCAGCTCCGCACGTCACCCCT
TGGGGGTCAGAAGAGCTGAAGTCAAAGACAGAAATTAGCCTGTGTTACAC
MTTGGGGAGAGAGTTCCTAGTGATTGTAGCCAGTAAGGCAGGTAAGGCCT
CAACTGTTGTCTGAGGACACAGTTTCTCCAACTGGGCTGATTTCTACCCA
G Celera SNP ID: hCV2084297
Public SNP ID: rs919766
SNP in Genomic Sequence: SEQ ID NO: 18
SNP Position: 19625

Genomic:
SNP Source: dbSNP; Celera; HapMap; HGBASE
Population (Allele, Count): caucasian (A, 110|C, 10)
SNP Type: INTRON Context
(SEQ ID NO: 61):
GTCTGCTTCAGGGCCCCTAA-
GATCTACGCCCTGGAGCTCT-
TGTTTTTATT
TTTGACTCAAGGTG-
CAATTTCAGCAAGTCATTTG-
TAGCTTTGAATTCTCC
KTTTATCCCTTTCTTTGGT-
GCTATGAGGCTTCAGGAAG-
CATGGCCAGGCA
ATTTGGATGAGTGGGT-
TCAAACACAGCAGAGACTAT-
TCTCAGTTCCCAAT
A Celera SNP ID: hCV2084298
Public SNP ID: rs2853694
SNP in Genomic Sequence: SEQ ID NO: 18
SNP Position: 21149
Genomic:
SNP Source: dbSNP; Celera; HapMap; HGBASE
Population (Allele, Count): caucasian (G, 65|T, 55)
SNP Type: INTRON Context
(SEQ ID NO: 62):
TATCTGCCTTACATTTGACTGAGGATTAAATGAAAAAAAAAAAAAGCACG
TAAAGTACTTAGCACAGTGTCTGCCACACAGTAAATTCGGTGTTAGTTAT
YGTTACTTATAGACTGAGGAGTCAGCCAACTGTACAGAGAAACTCTCTTA
ACAATTTTCCATGGATATTTAAGGATTTCGTTCCCTCTGTTTTAAATCAC
C Celera SNP ID: hCV2084301
Public SNP ID: rs3213093
SNP in Genomic Sequence: SEQ ID NO: 18
SNP Position: 23040
Genomic:
SNP Source: dbSNP; Celera; HGBASE
Population (Allele, Count): caucasian (C, 93|T, 27)
SNP Type: INTRON; REPEATS Context
(SEQ ID NO: 63):
TTCATGGAGCCATATTTTCTGGTCATAATTGTGTATCAGGTTCATTCATG
CTAATGAGAAAGGGATTCCAGATTTTCTTTGCATCTGTCTGCTTCTCACA
KGGCTGTTAAGAAGCCACCTGCCATTCTGACAATTTCATGTCCTTAGCCA
TAACTACTTGTCCTCTCTCTTGAATCTTAAGATCTTTTTGCCTTCCAGAC
A Celera SNP ID: hCV7537839
Public SNP ID: rs1368439
SNP in Genomic Sequence: SEQ ID NO: 18
SNP Position: 14075
Genomic:
SNP Source: dbSNP; Celera; HapMap; HGBASE;
Population (Allele, Count): caucasian (G, 26|T, 94)
SNP Type: UTR3; INTRON Context
(SEQ ID NO: 64):
GCAATGCTCAACTGTTTCAGTCAAATACCTTAAAAATGAGCATTCCTGGG
TTGGGTGACGGAATATTGACAAATTACAGCTTTGTCAGAACTGCTACTAA
STCTAGGCGGACCTTGCTATGTACTTTATTCCCTTATAAAGTTTGTGAGT
GGCAGAGACAGGCCTAGAAGTCAAGCCTTCTTGGACACTGCTCAGTGCTG
T

TABLE 2-continued

Genomic SNP info and associated gene information

| | |
|---|---|
| Celera SNP ID: | hCV27471935 |
| Public SNP ID: | rs3212217 |
| SNP in Genomic Sequence: | SEQ ID NO: 18 |
| SNP Position Genomic: | 27191 |
| SNP Source: | dbSNP; HapMap; HGBASE |
| Population (Allele, Count): | caucasian (G, 93\|C, 27) |
| SNP Type: | INTRON |

Context
(SEQ ID NO: 65):
GCCTCTCTGAGGAGGTGACATTTAGCTGACACCAAAAGGAAAGATGTCAG
TTGTGTTAAGAGCAGAGGGAAGCATATGTGCGAAGCACCTGCTAGGAGCC
RTGATCTTTGTGTGGAGCAGTGCCAGGCCTACAGAGCCCAACCACACACC
CTAGCATGTCTCTGCCTCCTCTTATCTAGAAGACCTAATTGAGGAAGGAG
T

| | |
|---|---|
| Celera SNP ID: | hCV32389158 |
| Public SNP ID: | rs3213102 |
| SNP in Genomic Sequence: | SEQ ID NO: 18 |
| SNP Position Genomic: | 18657 |
| SNP Source: | dbSNP; HapMap; HGBASE |
| Population (Allele, Count): | caucasian (G, 116\|A, 2) |
| SNP Type: | INTRON |

Context
(SEQ ID NO: 66):
CTCTTATTTTTAAGATGAGAAACTTAAAGCTTAGAGAAGGAATGTGACTT
TCTGGATCAACATCTAGCAGTTGTTTATTTAGTGCTTACTACATAAAGAG
MACTGGGCTAGAAGCAGTTGAGAGAGAAAAAAAGGGCTTACCTGGATCCC
GCTTCCTAGGAGCAAATACTTTTACTCAATAAATATTTATTAAGTCAGTG
T

| | |
|---|---|
| Celera SNP ID: | hDV68553886 |
| Public SNP ID: | rs3212220 |
| SNP in Genomic Sequence: | SEQ ID NO: 18 |
| SNP Position Genomic: | 26256 |
| SNP Source: | dbSNP; HapMap; ABI_Val; HGBASE |
| Population (Allele, Count): | caucasian (C, 93\|A, 27) |
| SNP Type: | INTRON |

Context
(SEQ ID NO: 67):
ATAGCTTTTCATTTTTTAACTGGGGCCAAAGTTAGTTAATCCACAAGAAT
GGGGATCCCAGCTGTCATTTTGGTTGATATCACAACTGACGACCAAGACC
RTCACAAATATGGGAGCAAGTCTGATTTGTAACATTATTATAATTATGAA
TCCAATTACTTTAAGGAATGCACGAAAGGCTTTTTAAAAATTTCAATAGT
A

| | |
|---|---|
| Celera SNP ID: | hDV71045748 |
| Public SNP ID: | rs6894567 |
| SNP in Genomic Sequence: | SEQ ID NO: 18 |
| SNP Position Genomic: | 29029 |
| SNP Source: | dbSNP; HapMap |
| Population (Allele, Count): | caucasian (A, 94\|G, 26) |
| SNP Type: | INTRON |

Context
(SEQ ID NO: 68):
ACAGACCTAGTTAGACCATAGTCCATATTTCAAATATAATTACATGTGCT
CATAGCTGAGAACCTTCTCCTGGGATGGATGCATTTCACCAGGTCACTGC
YGAAATGTTGTACTTTTATGGATGGTGATGAGGAAGCATCTGTTTTAGGT
GTGGTATTTCCTGGAGGCAGAAAACTGCTTGAGTTAGCTCATTCAGTTTT
T

| | |
|---|---|
| Celera SNP ID: | hCV31985592 |

TABLE 2-continued

Genomic SNP info and associated gene information

| | |
|---|---|
| Public SNP ID: | rs7709212 |
| SNP in Genomic Sequence: | SEQ ID NO: 18 |
| SNP Position Genomic: | 36238 |
| SNP Source: | dbSNP; HapMap; ABI_Val |
| Population (Allele, Count): | caucasian (T, 76\|C, 44) |
| SNP Type: | INTERGENIC; UNKNOWN |

Context
(SEQ ID NO: 69):
ACAGACCTAGTTAGACCATAGTCCATATTTCAAATATAATTACATGTGCT
CATAGCTGAGAACCTTCTCCTGGGATGGATGCATTTCACCAGGTCACTGC
YGAAATGTTGTACTTTTATGGATGGTGATGAGGAAGCATCTGTTTTAGGT
GTGGTATTTCCTGGAGGCAGAAAACTGCTTGAGTTAGCTCATTCAGTTTT
T

| | |
|---|---|
| Celera SNP ID: | hDV70665567 |
| Public SNP ID: | rs7709212 |
| SNP in Genomic Sequence: | SEQ ID NO: 18 |
| SNP Position Genomic: | 36238 |
| SNP Source: | dbSNP; HapMap; ABI_Val |
| Population (Allele, Count): | caucasian (T, 76\|C, 44) |
| SNP Type: | INTERGENIC; UNKNOWN |

Context
(SEQ ID NO: 70):
GCTTCCCAACACTGGTGCCAACATCAGCATGCCAATGACGCTTGGGTGGG
CATCTCTTTTTTAAGTTTTGTTTGTTACCTTTAATTAGAAAAGGGAGTTA
YTATTAAAGAATAAAAAGATATAGTCACAGATGGCATGGGTGGCACATGC
AAAGATCCCTAGTTTGAGGGCCAGGCAGACTTCTAGAACTGTGTGACTCT
G

| | |
|---|---|
| Celera SNP ID: | hCV3169809 |
| Public SNP ID: | rs730691 |
| SNP in Genomic Sequence: | SEQ ID NO: 18 |
| SNP Position Genomic: | 28288 |
| Related Interrogated SNP: | hCV2084293 (Power = .6) |
| Related Interrogated SNP: | hCV30449508 (Power = .6) |
| SNP Source: | dbSNP; Celera; HapMap; ABI_Val; HGBASE |
| Population (Allele, Count): | caucasian (T, 47\|C, 73) |
| SNP Type: | TRANSCRIPTION FACTOR BINDING SITE; INTRON |

Context
(SEQ ID NO: 71):
GAGAAACTTCCAGCACAATTTCAGTTTCATAGAGAATACGGCAGGGCACA
ATATTCAGCAGAGTAACATAGTGGTTAAAAGCTCAGGGTGTCGAGAACAA
YGAACCAAGACTGTCATCCTGTCTCCACTAACCAGCTGGGGGATTTGGAA
CAAGGTATTTCATTATCATGAGCCTCAGTTTCCT CATCTGTAAAATGATA
A

| | |
|---|---|
| Celera SNP ID: | hCV29927086 |
| Public SNP ID: | rs3213094 |
| SNP in Genomic Sequence: | SEQ ID NO: 18 |
| SNP Position Genomic: | 22830 |
| Related Interrogated SNP: | hCV2084293 (Power = .9) |
| Related Interrogated SNP: | hCV30449508 (Power = .8) |
| SNP Source: | dbSNP; HapMap; HGBASE |
| Population (Allele, Count): | caucasian (C, 93\|T, 27) |
| SNP Type: | INTRON; REPEATS |
| Gene Number: | 7 |

TABLE 2-continued

Genomic SNP info and associated gene information

| | |
|---|---|
| Celera Gene: | hCG2038173 - 208000027037926 |
| Gene Symbol: | |
| Protein Name: | |
| Celera Genomic Axis: | GA_x5YUV32VUFE (16437748 . . . 16475467) |
| Chromosome: | 5 |
| OMIM NUMBER: | |
| OMIM Information: | |
| Genomic Sequence (SEQ ID NO: 19): | |

SNP Information

Context
(SEQ ID NO: 72):
ATCCTCAGAAGTGGGCGGCAGAGAAGGAGGAACGTGCTTGAGTCGCAGTC
CCCAAAAAGGGAGGAACTCATTGGCCCAGCTTAGGCCTGGTGTCTGCCTA
YCTGTGGTTCAGTCAGCTGTGGTCGGTGGGCAGGACACACCTGAAGGAGC
ATATCTTGGCTGTGTGGGTTGGGCAGACATCCCACAATGCTCATGTAGGG
G

| | |
|---|---|
| Celera SNP ID: | hCV28024675 |
| Public SNP ID: | rs4921230 |
| SNP in Genomic Sequence: | SEQ ID NO: 19 |
| SNP Position Genomic: | 14833 |
| SNP Source: | dbSNP; HapMap; HGBASE |
| Population (Allele, Count): | caucasian (C, 88\|T, 30) |
| SNP Type: | DONOR SPLICE SITE |
| Gene Number: | 8 |
| Celera Gene: | Chr5: 154787857 . . . 154898929 |
| Gene Symbol: | |
| Protein Name: | |
| Celera Genomic Axis: | GA_x5YUV32VUFE (16472963 . . . 16584035) |
| Chromosome: | 5 |
| OMIM NUMBER: | |
| OMIM Information: | |
| Genomic Sequence (SEQ ID NO: 20): | |

SNP Information

Context
(SEQ ID NO: 73):
TCAAAGCAGAACCTTAGGCTCTAAGGGAAACAAGACAGAAGGATTCTGCT
GACAAGACAGTAAAGTAGCCTGCTCATCTGGTGGTAGGCACTGTGTCAGC
RTTCTAGGTTGTAAATGTAGGAAGTAAGCAGATCAGAGGTTTGCTCAACA
ACCTGCCTAGTGAGCCAAACTGCTTGCTCTTGAGGCCATGTAGTCCTTCT
G

| | |
|---|---|
| Celera SNP ID: | hCV1994965 |
| Public SNP ID: | rs953861 |
| SNP in Genomic Sequence: | SEQ ID NO: 20 |
| SNP Position Genomic: | 15582 |
| SNP Source: | dbSNP; Celera; HapMap; ABI_Val |
| Poputation (Allele, Count): | caucasian (G, 20\|A, 100) |
| SNP Type: | TRANSCRIPTION FACTOR BINDING SITE; INTERGENIC; UNKNOWN |

Context
(SEQ ID NO: 74):
CACTAATATGAGAACAATCTCTTTAGGACTGGAAACCACGAAGTCAATTG
AATTGAATGCACCACAACCCAGTGAGTTAAATCTTTGTGGAAAGATTCCA
SAAATGCCTCTAAAGTTGCATCTATAAGCTTAATGATCTTATGTCTGTGT
CTCCATGGATGCCAAGTGATATGATTTGGATCTCTATCCCCACCCAAATC
T

TABLE 2-continued

Genomic SNP info and associated gene information

| | |
|---|---|
| Celera SNP ID: | hCV1994990 |
| Public SNP ID: | rs6861600 |
| SNP in Genomic Sequence: | SEQ ID NO: 20 |
| SNP Position Genomic: | 62615 |
| SNP Source: | dbSNP; Celera |
| Population (Allele, Count): | caucasian (C, 82\|G, 38) |
| SNP Type: | INTERGENIC; UNKNOWN |

Context
(SEQ ID NO: 75):
CTGACTTGCTTCATACTTCTTCCTGCCTCCGCTAGCCTCCACCCAGGGAA
GGTGTGCTTCTCGGTAAGTCAGTTTGAGAGAAGCAGTGTAGTGTAGTGGT
SAATAGTCTGGATTTACATCTTTGATCTTCCATTTACTACGCTTGTGACC
TAGGGGGTGTTGCTTCCCCTCTCTGTTCCAATTATTTATCCATAAAATAG
A

| | |
|---|---|
| Celera SNP ID: | hCV1994992 |
| Public SNP ID: | rs6887695 |
| SNP in Genomic Sequence: | SEQ ID NO: 20 |
| SNP Position Genomic: | 65645 |
| SNP Source: | dbSNP; Celera; HapMap; ABI_Val |
| Population (Allele, Count): | caucasian (G, 82\|C, 38) |
| SNP Type: | INTERGENIC; UNKNOWN |

Context
(SEQ ID NO: 76):
TAAATTTCCAACTCATGCCTTTTGGGGGACACATTCAAACTATAGCAAAT
ACTAAGTTAAGGAAGTTTCAGCTCTGTCTGGCAGCCTCATAATATTTCAA
YGCTTCATCATTTGAATGCTTATTAATTAACCAACTTCCTGTATGCCATG
TGATCAGATGTCACAAGAGGAGTTCCTTTGGGATGAACTTAGTTCTTTGT
G

| | |
|---|---|
| Celera SNP ID: | hCV1995017 |
| Public SNP ID: | rs4921496 |
| SNP in Genomic Sequence: | SEQ ID NO: 20 |
| SNP Position Genomic: | 91073 |
| SNP Source: | dbSNP; Celera; HapMap; ABI_Val; HGBASE |
| Population (Allele, Count): | caucasian (T, 27\|C, 93) |
| SNP Type: | INTERGENIC; UNKNOWN |

Context
(SEQ ID NO: 77):
TGCTTACTAGAGACCAAAATGCCAAGATTTCAACGGGGGCCAGCCACCCT
GGTTTCTATTTTGATGTGATTACTTAGTCATTTAAAGTCAGGTTAATGTT
SGCCAACAACAGATGGGGTCAGGACACAGGAGTTCTGCAGCTCACTGGAA
CTGGACAGTCTTTTAGGGCACCCAGCTCACAAGGCCACACCGTGGCCCGC
C

| | |
|---|---|
| Celera SNP ID: | hCV7538755 |
| Public SNP ID: | rs918520 |
| SNP in Genomic Sequence: | SEQ ID NO: 20 |
| SNP Position Genomic: | 69310 |
| SNP Source: | dbSNP; Celera; HapMap; ABI_Val; HGBASE |
| Population (Allele, Count): | caucasian (C, 20\|G, 100) |
| SNP Type: | TRANSCRIPTION FACTOR BINDING SITE; INTERGENIC; UNKNOWN |

Context
(SEQ ID NO: 78):
TGTTTTAGGATCAAAATAATGAAAAAGAATAGAAACCATTTCAACTCAGA
AAATAATTCAAAGATGGGAAAAAGGTGTGTACCAAATTCATTGCTCTAAT
YATTTCTGTTCTGATAAAAGGAGTTTACAGCAAAGGAATAACTTTTCTGT TABLE 2-continued Genomic SNP info and associated gene information

GTCTCTGAGGCTTTGGAAAAACAAGGCATCAAGAAGCTTTGGGGTGTGGT
G

| | |
|---|---|
| Celera SNP ID: | hCV7538761 |
| Public SNP ID: | rs1422878 |
| SNP in Genomic Sequence: | SEQ ID NO: 20 |
| SNP Position Genomic: | 82217 |
| SNP Source: | dbSNP; Celera; HapMap; ABI_Val; HGBASE |
| Population (Allele, Count): | caucasian (C, 68\|T, 52) |
| SNP Type: | INTERGENIC; UNKNOWN |

Context
(SEQ ID NO: 79):
GTGGTCTGAACGTTTATGTCTCCCTAAAATTCATATGTTGAATTCCTAAC
CCCCAAGGTGAGAGTGTTGGGAGGTGGAGCCTTTTAGTCTCCTGGCTGGG
MTTAGTGGCCTGATAACATAGACTCCAGAGAGCTGGCTTATTCCTTCCAC
TATGTGAGGACACAGCAAGAAGCCGCTGTCTGTGGGGAAACAGAGGCTTA
C

| | |
|---|---|
| Celera SNP ID: | hCV29349404 |
| Public SNP ID: | rs7704367 |
| SNP in Genomic Sequence: | SEQ ID NO: 20 |
| SNP Position Genomic: | 64493 |
| SNP Source: | dbSNP; HapMap |
| Population (Allele, Count): | caucasian (A, 75\|C, 37) |
| SNP Type: | TRANSCRIPTION FACTOR BINDING SITE; INTERGENIC; UNKNOWN; REPEATS |

Context
(SEQ ID NO: 80):
ACAGACCTAGTTAGACCATAGTCCATATTTCAAATATAATTACATGTGCT
CATAGCTGAGAACCTTCTCCTGGGATGGATGCATTTCACCAGGTCACTGC
YGAAATGTTGTACTTTTATGGATGGTGATGAGGAAGCATCTGTTTTAGGT
GTGGTATTTCCTGGAGGCAGAAAACTGCTTGAGTTAGCTCATTCAGTTTT
T

| | |
|---|---|
| Celera SNP ID: | hCV31985592 |
| Public SNP ID: | rs7709212 |
| SNP in Genomic Sequence: | SEQ ID NO: 20 |
| SNP Position Genomic: | 7177 |
| SNP Source: | dbSNP; HapMap; ABI_Val |
| Population (Allele, Count): | caucasian (T, 76\|C, 44) |
| SNP Type: | INTERGENIC; UNKNOWN |

Context
(SEQ ID NO: 81):
ACAGACCTAGTTAGACCATAGTCCATATTTCAAATATAATTACATGTGCT
CATAGCTGAGAACCTTCTCCTGGGATGGATGCATTTCACCAGGTCACTGC
YGAAATGTTGTACTTTTATGGATGGTGATGAGGAAGCATCTGTTTTAGGT
GTGGTATTTCCTGGAGGCAGAAAACTGCTTGAGTTAGCTCATTCAGTTTT
T

| | |
|---|---|
| Celera SNP ID: | hDV70665567 |
| Public SNP ID: | rs7709212 |
| SNP in Genomic Sequence: | SEQ ID NO: 20 |
| SNP Position Genomic: | 7177 |
| SNP Source: | dbSNP; HapMap; ABI_Val |
| Population (Allele, Count): | caucasian (T, 76\|C, 44) |
| SNP Type: | INTERGENIC; UNKNOWN |

Context
(SEQ ID NO: 82):
CTTCTTTATTTTCTCAACAATGTTTTGCAGTTCTCAGCATATAACTTTCA
TTTCTTTTGTTCAATTTATTCCTAAGTATTTAATACTTTTTGGTGCTATT TABLE 2-continued Genomic SNP info and associated gene information KCAGATGAATTTTCCTATTAATTTTCATATTGGTCATTGCAATTGTATAA
AAATACAATTATTTTTGTATATTGATCTTGTTTCATGCAATCTTGCTGTG
A

| | |
|---|---|
| Celera SNP ID: | hCV1994971 |
| Public SNP ID: | rs7725339 |
| SNP in Genomic Sequence: | SEQ ID NO: 20 |
| SNP Position Genomic: | 20001 |
| Related Interrogated SNP: | hCV1994992 (Power = .8) |
| Related Interrogated SNP: | hCV31985592 (Power = .7) |
| Related Interrogated SNP: | hCV2084293 (Power = .51) |
| Related Interrogated SNP: | hCV30449508 (Power = .51) |
| SNP Source: | dbSNP; Celera; HapMap |
| Population (Allele, Count): | caucasian (G, 73\|T, 35) |
| SNP Type: | INTERGENIC; UNKNOWN; REPEATS |

Context
(SEQ ID NO: 83):
TAAATAAAATAAAATAAAGTAGAAAAGAAACAAAAATTATAAGATAGGGA
CATTAAATGGAGTTAGAAATGAGGCTAATAAATAATGAATATGCTGCACC
RTGGAATACTACTCAGCCATAAAACAGAACAAAATAATGGACTTTGCAGC
AACTTGGATGGAGCTGGAAGCCATTATCTTAAGTGAAATAATTCACAAAT
G

| | |
|---|---|
| Celera SNP ID: | hCV31985582 |
| Public SNP ID: | rs6556412 |
| SNP in Genomic Sequence: | SEQ ID NO: 20 |
| SNP Position Genomic: | 30385 |
| Related Interrogated SNP: | hCV1994992 (Power = .8) |
| Related Interrogated SNP: | hCV2084293 (Power = .51) |
| SNP Source: | dbSNP; HapMap |
| Population (Allele, Count): | caucasian (G, 79\|A, 39) |
| SNP Type: | INTERGENIC; UNKNOWN |
| Gene Number: | 9 |
| Celera Gene: | Chr5: 154681788 . . . 154721788 |
| Gene Symbol: | |
| Protein Name: | |
| Celera Genomic Axis: | GA_x5YUV32VUFE (16650104 . . . 16690104) |
| Chromosome: | 5 |
| OMIM NUMBER: | |
| OMIM Information: | |
| Genomic Sequence (SEQ ID NO: 21): | |

SNP Information

Context
(SEQ ID NO: 84):
CCAATCCCCTACCAATACCAAAGGACAACTGTTACATCATAAGCTCTTAT
TACTTAACATTCATTATTCATTCATTCAGCATATATTTATTGAGCATCTA
YGTTAGCCAATATCATGCTAGGTTCTGAGAATGGAAAGGTGAATAAATTG
TCTGTTCCTTAACAAAATTTACTGATATGGTTTGTCTTTGTGTCCCCACC
C

| | |
|---|---|
| Celera SNP ID: | hCV2081926 |
| Public SNP ID: | rs11744690 |
| SNP in Genomic Sequence: | SEQ ID NO: 21 |
| SNP Position Genomic: | 36217 |
| SNP Source: | dbSNP; Celera; HapMap; ABI_Val |

TABLE 2-continued

Genomic SNP info and associated gene information

| | |
|---|---|
| Population (Allele, Count): | caucasian (T, 81\|C, 39) |
| SNP Type: | INTERGENIC; UNKNOWN; REPEATS |

Context
(SEQ ID NO: 85):
TAAATTGAAACATTATGTGGCCTTTCGTGTGGGTTCTTTAACTTAGGATA
GTGTTTTCAAGTTTCATCCATATTGTAGCAAGTATCAGCACTTCATTCCA
YTTTATGGCTGGATGACATTCCAATGTATGGGTCTGCCATATTTTGTTCA
TGCCATTTATCCACTCATGGATATGTAGCTTGTTTCCACTTTCTGCCCAT
T

| | |
|---|---|
| Celera SNP ID: | hDV70267720 |
| Public SNP ID: | rs7719425 |
| SNP in Genomic Sequence: | SEQ ID NO: 21 |
| SNP Position Genomic: | 20001 |
| SNP Source: | dbSNP; HapMap |
| Population (Allele, Count): | caucasian (T, 96\|C, 24) |
| SNP Type: | INTERGENIC; UNKNOWN |
| Gene Number: | 10 |
| Celera Gene: | Chr5: 154576292 . . . 154616292 |
| Gene Symbol: | |
| Protein Name: | |
| Celera Genomic Axis: | GA_x5YUV32VUFE (16755600 . . . 16795600) |
| Chromosome: | 5 |
| OMIM NUMBER: | |
| OMIM Information: | |

Genomic Sequence
(SEQ ID NO: 22):

SNP Information

Context
(SEQ ID NO: 86):
GCTTTCTACCAACAGATGTGCAGGGTATTTTTCCCTCTGCCCTTGTTTGT
TCATTAATCCATGGTAGGGGACACCAATGGATGGTCACAGTTATGATTCC
YCCCATCAATGTGTTTTGCTTGGTTTTCATAGCATTTTTAATTATTTATT
TTTGGAGACAGAGTCTCATTCTGTCACCCAGGCTGGAGTACAGTGGCGTG
A

| | |
|---|---|
| Celera SNP ID: | hCV3220380 |
| Public SNP ID: | rs270654 |
| SNP in Genomic Sequence: | SEQ ID NO: 22 |
| SNP Position Genomic: | 20001 |
| SNP Source: | dbSNP; HapMap |
| Population (Allele, Count): | caucasian (T, 109\|C, 11) |
| SNP Type: | INTERGENIC; UNKNOWN |

Context
(SEQ ID NO: 87):
AGCTTGAAGAGACTAAGAGCAGGCAATCCAAGTCTCCTCCACATGTGGAA
ACCAAGTCCAGAGACGGAGCAGTAACTGCCCGGCTCCCACGGCTTGTAAT
YGCAGAAACAAGCTTTAAGCCGGCTGCCTCCTTCCTCGTTGCTTTTACCA
TTATTTAATTTGTAGGCTTCACAAAGGCTATATGTGTTGAAATTGGCTAA
A

| | |
|---|---|
| Celera SNP ID: | hCV3220386 |
| Public SNP ID: | rs270661 |
| SNP in Genomic Sequence: | SEQ ID NO: 22 |
| SNP Position Genomic: | 15035 |
| SNP Source: | dbSNP; Celera; HapMap; ABI_Val; HGBASE |
| Population (Allele, Count): | caucasian (C, 95\|T, 25) |
| SNP Type: | INTERGENIC; UNKNOWN |
| Gene Number: | 11 |
| Celera Gene: | Chr1: 66009859 . . . 66049859 |
| Gene Symbol: | |
| Protein Name: | |
| Celera Genomic Axis: | GA_x5YUV32W802 (15835073 . . . 15875073) |
| Chromosome: | 1 |
| OMIM NUMBER: | |
| OMIM Information: | |

Genomic Sequence
(SEQ ID NO: 23):

SNP Information

Context
(SEQ ID NO: 88):
CAGTGGAAATAAATATTTGATGTTATTTTTCAATAAATTGTTACTGGAGTT
AAACCTCTTGCTATCCTGACAATTCCTCCCTACATCACCCTCTTTGCAAT
RGCAGATGGAAGAATTGGCAATAAATGCAATTCAGCTTGAAGAAAACACC
CTAAATATTAGAAACCTGTGAAGAACCACCGGATTGCCTTATCAACTCAT
T

| | |
|---|---|
| Celera SNP ID: | hCV2720238 |
| Public SNP ID: | rs11209032 |
| SNP in Genomic Sequence: | SEQ ID NO: 23 |
| SNP Position Genomic: | 20001 |
| SNP Source: | dbSNP; Celera; HapMap |
| Population (Allele, Count): | caucasian (G, 83\|A, 37) |
| SNP Type: | INTERGENIC; UNKNOWN |

Context
(SEQ ID NO: 89):
GGCCTCCCCAGCCATATGGAACTGTAAGTCCATTAAATCTCTTTTTTTTG
CAAATTGCCCAGTCTTGGGTATGTCTTTACCAGCAGCGTGAAAATGGACT
WATACAGCATTTACCACAGTGTCTGGCTCATAGTAACTGTGGCAGAGCCT
GCTAATTGTCCGTTCAACTTCCGTTCTCAAATTCTTACTTCCTAACAGAA
C

| | |
|---|---|
| Celera SNP ID: | hCV31222786 |
| Public SNP ID: | rs1857292 |
| SNP in Genomic Sequence: | SEQ ID NO: 23 |
| SNP Position Genomic: | 18231 |
| SNP Source: | dbSNP; HapMap; HGBASE |
| Population (Allele, Count): | caucasian (T, 10\|A, 106) |
| SNP Type: | INTERGENIC; UNKNOWN; REPEATS |

TABLE 3

Primers

| Marker | Alleles | Primer 1 (Allele-specific Primer) | Primer 2 (Allele-specific Primer) | Common Primer |
|---|---|---|---|---|
| hCV2084297 | A/C | ACTAGGAACTCTCTCCCCAAT (SEQ ID NO: 90) | CTAGGAACTCTCTCCCCAAG (SEQ ID NO: 91) | TGTTGTCCCCTCTGACTCTC (SEQ ID NO: 92) |

TABLE 3-continued

Primers

| Marker | Alleles | Primer 1 (Allele-specific Primer) | Primer 2 (Allele-specific Primer) | Common Primer |
|---|---|---|---|---|
| hCV2084296 | C/T | GGAATTCTGCTGTAAGGC (SEQ ID NO: 93) | AAGGAATTCTGCTGTAAGGT (SEQ ID NO: 94) | CTCCTGGCTGTTCCAGATAT (SEQ ID NO: 95) |
| hCV90 | A/G | TGCAAAAACCTACCCAGTTT (SEQ ID NO: 96) | TGCAAAAACCTACCCAGTTC (SEQ ID NO: 97) | TTCATTAGACAACAGAGGAGACAT (SEQ ID NO: 98) |
| hCV1992693 | A/G | CGGCCATGGTTCTAAGAAA (SEQ ID NO: 99) | CGGCCATGGTTCTAAGAAG (SEQ ID NO: 100) | GAAATGTGGGCTGAGGGATAG (SEQ ID NO: 101) |
| hCV1994965 | A/G | TTACTTCCTACATTTACAACCTAGAAT (SEQ ID NO: 102) | ACTTCCTACATTTACAACCTAGAAC (SEQ ID NO: 103) | GAGGAGACCTCAAAGCAGAACCTTA (SEQ ID NO: 104) |
| hCV1994992 | C/G | GATCAAAGATGTAAATCCAGACTATTG (SEQ ID NO: 105) | GATCAAAGATGTAAATCCAGAC-TATTC (SEQ ID NO: 106) | CCTCTGTGTTCACACTGATATCAATAC CT (SEQ ID NO: 107) |
| hCV1995017 | C/T | TGGCAGCCTCATAATATTTCAAC (SEQ ID NO: 108) | TGGCAGCCTCATAATATTTCAAT (SEQ ID NO: 109) | CACAATGGTGCACAAAGAACTAAGT (SEQ ID NO: 110) |
| hCV2081970 | C/T | AATTAACTTTAGAATCAGACTTGATAC AG (SEQ ID NO: 111) | AAATTAACTTTAGAATCAGACT-TGATA CAA (SEQ ID NO: 112) | CAGCCCAGGAGTTGGACAAG (SEQ ID NO: 113) |
| hCV3220380 | C/T | GATGGTCACAGTTATGATTCCC (SEQ ID NO: 114) | GATGGTCACAGTTATGATTCCT (SEQ ID NO: 115) | CCTGGGTGACAGAATGAGACTC (SEQ ID NO: 116) |
| hCV3220386 | C/T | CTCCCACGGCTTGTAATC (SEQ ID NO: 117) | CTCCCACGGCTTGTAATT (SEQ ID NO: 118) | GCACATTTAGCCAATTTCAACACATAT (SEQ ID NO: 119) |
| hCV7537756 | C/G | TGGAGCTCAAATGTTGGTTAG (SEQ ID NO: 120) | TGGAGCTCAAATGTTGGTTAC (SEQ ID NO: 121) | CCTGTTCTTGCAAGGAGGTGATC (SEQ ID NO: 122) |
| hCV7538755 | C/G | TTAGTCATTTAAAGTCAGGTTAATGTT C (SEQ ID NO: 123) | TAGTCATTTAAAGTCAGGTTAAT-GTTG (SEQ ID NO: 124) | CGGTGTGGCCTTGTGAG (SEQ ID NO: 125) |
| hCV7538761 | C/T | GTGTACCAAATTCATTGCTCTAATC (SEQ ID NO: 126) | GTGTACCAAATTCATTGCTCTAATT (SEQ ID NO: 127) | CAAAGCTTCTTGATGCCTTGTTT (SEQ ID NO: 128) |
| hDV68553886 | G/T | ACTGCTTCTAGCCCAGTG (SEQ ID NO: 129) | ACTGCTTCTAGCCCAGTT (SEQ ID NO: 130) | ACCTAAGGCAAGCCATCTGATAC (SEQ ID NO: 131) |
| hDV70663683 | C/T | CTGTCTCCGAGAGAGGG (SEQ ID NO: 132) | TCTCCGAGAGAGGCTCTAA (SEQ ID NO: 133) | GGGCTGATGCTTGGAGATTGT (SEQ ID NO: 134) |
| hCV28024675 | C/T | GCTGACTGAACCACAGG (SEQ ID NO: 135) | AGCTGACTGAACCAACAGA (SEQ ID NO: 136) | GAAGTGGGCGGCAGAGAA (SEQ ID NO: 137) |
| hCV2084301 | C/T | CACAGTAAATTCGGTGTTAGTTATC (SEQ ID NO: 138) | CACAGTAAATTCGGTGTTAGTTATT (SEQ ID NO: 139) | TCCACTGGTGATTTAAAACAGA (SEQ ID NO: 140) |
| hCV2990018 | C/T | CAGCCTTGGAGTTCACC (SEQ ID NO: 141) | GCAGCCTTGGAGTTCACT (SEQ ID NO: 142) | TGTGCTCAGCAGAAAAGATATAT (SEQ ID NO: 143) |
| hCV1994990 | C/G | GATGCAACTTTAGAGGCATTTG (SEQ ID NO: 144) | GATGCAACTTTAGAGGCATTTC (SEQ ID NO: 145) | TTAGGACTGGAAACCACGAAGTCAA (SEQ ID NO: 146) |
| hCV2081982 | A/G | TTCGATCAGGCAGTAGGATAT (SEQ ID NO: 147) | TCGATCAGGCAGTAGGATAC (SEQ ID NO: 148) | CATTTGTTGGTTACTAACAGCACTGA A (SEQ ID NO: 149) |
| hCV2084270 | A/G | CAACCAAGAAATAGTCATTTACAGAA (SEQ ID NO: 150) | CAACCAAGAAATAGTCATTTACAGAG (SEQ ID NO: 151) | ATCAGGAGCTGGAGGAAACTTCT (SEQ ID NO: 152) |
| hCV2084281 | C/T | GGGGTGCTGTGTTTCTTTC (SEQ ID NO: 153) | GGGGTGCTGTGTTTCTTTT (SEQ ID NO: 154) | CTAACAGCTGTAATGAGGTATAGTTCA CATACTC (SEQ ID NO: 155) |
| hCV27471935 | C/G | GCTTTGTCAGAACTGCTACTAAC (SEQ ID NO: 156) | GCTTTGTCAGAACTGCTACTAAG (SEQ ID NO: 157) | CAGTGTCCAAGAAGGCTTGACTT (SEQ ID NO: 158) |

TABLE 3-continued

| Marker | Alleles | Primer 1 (Allele-specific Primer) | Primer 2 (Allele-specific Primer) | Common Primer |
|---|---|---|---|---|
| hCV2934904 | A/C | AGTCTATGTTATCAGGCCACTAAT (SEQ ID NO: 159) | GTCTATGTTATCAGGCCACTAAG (SEQ ID NO: 160) | GATGCTGTGGTCTGAACGTTTATGT (SEQ ID NO: 161) |
| hCV30377542 | G/T | CAATGGCAAAGCTGTTAGTG (SEQ ID NO: 162) | ACAATGGCAAAGCTGTTAGTT (SEQ ID NO: 163) | GCTGGGATTATAGGTGTGCACTACT (SEQ ID NO: 164) |
| hDV70267720 | C/T | GGAATGTCATCCAGCCATAAAG (SEQ ID NO: 165) | GGAATGTCATCCAGCCATAAAA (SEQ ID NO: 166) | GCCTTTCGTGTGGGTTCTTTAACT (SEQ ID NO: 167) |
| hDV70665567 | C/T | TCACCAGGTCACTGCC (SEQ ID NO: 168) | TTCACCAGGTCACTGCT (SEQ ID NO: 169) | GCAGTTTTCTGCCTCCAGGAAATAC (SEQ ID NO: 170) |
| hDV71045748 | A/G | AACTGACGACCAAGACCA (SEQ ID NO: 171) | ACTGACGACCAAGACCG (SEQ ID NO: 172) | TGAGTGGTGCCTGCCTTACTATT (SEQ ID NO: 173) |
| hCV1272348 | C/T | CGAAGTTCTCTGGTCCCG (SEQ ID NO: 174) | CGAAGTTCTCTGGTCCCA (SEQ ID NO: 175) | CCGCACCCACTGTCTGATAAAC (SEQ ID NO: 176) |
| hCV2720238 | A/G | CTACATCACCCTCTTTGCAATA (SEQ ID NO: 177) | ACATCACCCTCTTTGCAATG (SEQ ID NO: 178) | CGGTGGTTCTTCACAGGTTTCTAATA (SEQ ID NO: 179) |
| hCV2720255 | G/T | AGCTTTTGCAAGCTCAAAATTAC (SEQ ID NO: 180) | AGCTTTTGCAAGCTCAAAATTAA (SEQ ID NO: 181) | CAGGCCACCACTGTGAAAGTAA (SEQ ID NO: 182) |
| hCV31222786 | A/T | ACACTGTGGTAAATGCTGTATT (SEQ ID NO: 183) | GACACTGTGGTAAATGCTGTATA (SEQ ID NO: 184) | CCCAGCCATATGGAACTGTAAGT (SEQ ID NO: 185) |
| hCV31222825 | A/G | GGGAAGCAAAATTAACCTTTACT (SEQ ID NO: 186) | GGGAAGCAAAATTAACCTTTACC (SEQ ID NO: 187) | CACATTTGCCAGAGATGCACTTCTA (SEQ ID NO: 188) |
| hCV31222838 | G/T | GATGGGTTAAAATGGGCAATTC (SEQ ID NO: 189) | TGATGGGTTAAAATGGGCAATTA (SEQ ID NO: 190) | GCTAACAGTTGCTTCCATCTCTACA (SEQ ID NO: 191) |
| hCV2084293 | G/T | CAATGAGCATTTAGCATCG (SEQ ID NO: 192) | TTCAATGAGCATTTAGCATCT (SEQ ID NO: 193) | TGGAGGAAAAGTGGAAGATATTA (SEQ ID NO: 194) |
| hCV2084298 | G/T | GCACCAAAGAAAGGGATAAAC (SEQ ID NO: 195) | GCACCAAAGAAAGGGATAAAA (SEQ ID NO: 196) | CCTCATCGAGTTTTGGAGTCT (SEQ ID NO: 197) |
| hCV7537839 | G/T | CATCTGTCTGCTTCTCACAG (SEQ ID NO: 198) | CATCTGTCTGCTTCTCACAT (SEQ ID NO: 199) | GTCTGGAAGGCAAAAAGATC (SEQ ID NO: 200) |

TABLE 4

Linkage Disequilibrium (LD) SNPs

| Interrogated SNP | Interrogated rs | LD SNP | LD SNP rs | Power | Threshold $r^2$ | $r^2$ |
|---|---|---|---|---|---|---|
| hCV1994992 | rs6887695 | hCV11269323 | rs11135059 | 0.51 | 0.41 | 0.96248 |
| hCV1994992 | rs6887695 | hCV15894458 | rs2546890 | 0.51 | 0.41 | 0.47424 |
| hCV1994992 | rs6887695 | hCV1994971 | rs7725339 | 0.51 | 0.41 | 0.9583 |
| hCV1994992 | rs6887695 | hCV1994990 | rs6861600 | 0.51 | 0.41 | 1 |
| hCV1994992 | rs6887695 | hCV2084283 | rs1549922 | 0.51 | 0.41 | 0.44522 |
| hCV1994992 | rs6887695 | hCV2084298 | rs2853694 | 0.51 | 0.41 | 0.43863 |
| hCV1994992 | rs6887695 | hCV27106359 | rs12522665 | 0.51 | 0.41 | 1 |
| hCV1994992 | rs6887695 | hCV29349404 | rs7704367 | 0.51 | 0.41 | 1 |
| hCV1994992 | rs6887695 | hCV31985582 | rs6556412 | 0.51 | 0.41 | 0.96218 |
| hCV1994992 | rs6887695 | hCV31985592 | rs7709212 | 0.51 | 0.41 | 0.76043 |
| hCV1994992 | rs6887695 | hDV70665567 | rs7709212 | 0.51 | 0.41 | 0.73433 |
| hCV2084293 | rs3212227 | hCV11269323 | rs11135059 | 0.51 | 0.28 | 0.30508 |
| hCV2084293 | rs3212227 | hCV15803290 | rs2421047 | 0.51 | 0.28 | 1 |
| hCV2084293 | rs3212227 | hCV15879826 | rs2288831 | 0.51 | 0.28 | 1 |
| hCV2084293 | rs3212227 | hCV15894458 | rs2546890 | 0.51 | 0.28 | 0.3318 |
| hCV2084293 | rs3212227 | hCV1994971 | rs7725339 | 0.51 | 0.28 | 0.32318 |
| hCV2084293 | rs3212227 | hCV2081927 | rs194228 | 0.51 | 0.28 | 0.36701 |
| hCV2084293 | rs3212227 | hCV2081970 | rs1897565 | 0.51 | 0.28 | 0.43743 |
| hCV2084293 | rs3212227 | hCV2081982 | rs10076782 | 0.51 | 0.28 | 0.43743 |
| hCV2084293 | rs3212227 | hCV2084254 | rs2420825 | 0.51 | 0.28 | 0.38665 |
| hCV2084293 | rs3212227 | hCV2084255 | rs3734104 | 0.51 | 0.28 | 0.36701 |
| hCV2084293 | rs3212227 | hCV2084256 | rs4147384 | 0.51 | 0.28 | 0.29964 |

TABLE 4-continued

Linkage Disequilibrium (LD) SNPs

| | Interrogated | | | | Threshold | |
|---|---|---|---|---|---|---|
| Interrogated SNP | rs | LD SNP | LD SNP rs | Power | $r^2$ | $r^2$ |
| hCV2084293 | rs3212227 | hCV2084261 | rs1368438 | 0.51 | 0.28 | 0.2808 |
| hCV2084293 | rs3212227 | hCV2084262 | rs17665189 | 0.51 | 0.28 | 0.36701 |
| hCV2084293 | rs3212227 | hCV2084270 | rs2082412 | 0.51 | 0.28 | 1 |
| hCV2084293 | rs3212227 | hCV2084272 | rs2116821 | 0.51 | 0.28 | 0.42118 |
| hCV2084293 | rs3212227 | hCV2084281 | rs7730390 | 0.51 | 0.28 | 0.9061 |
| hCV2084293 | rs3212227 | hCV2084283 | rs1549922 | 0.51 | 0.28 | 0.31009 |
| hCV2084293 | rs3212227 | hCV2084298 | rs2853694 | 0.51 | 0.28 | 0.34311 |
| hCV2084293 | rs3212227 | hCV2084301 | rs3213093 | 0.51 | 0.28 | 1 |
| hCV2084293 | rs3212227 | hCV27471935 | rs3212217 | 0.51 | 0.28 | 1 |
| hCV2084293 | rs3212227 | hCV27486507 | rs3212219 | 0.51 | 0.28 | 1 |
| hCV2084293 | rs3212227 | hCV27508808 | rs3212218 | 0.51 | 0.28 | 1 |
| hCV2084293 | rs3212227 | hCV27841092 | rs6556405 | 0.51 | 0.28 | 0.43067 |
| hCV2084293 | rs3212227 | hCV27883435 | rs7381075 | 0.51 | 0.28 | 0.95073 |
| hCV2084293 | rs3212227 | hCV29349409 | rs6859018 | 0.51 | 0.28 | 1 |
| hCV2084293 | rs3212227 | hCV29619986 | rs10072923 | 0.51 | 0.28 | 1 |
| hCV2084293 | rs3212227 | hCV29927086 | rs3213094 | 0.51 | 0.28 | 1 |
| hCV2084293 | rs3212227 | hCV30377542 | rs6888950 | 0.51 | 0.28 | 0.47474 |
| hCV2084293 | rs3212227 | hCV30449508 | rs3212220 | 0.51 | 0.28 | 1 |
| hCV2084293 | rs3212227 | hCV30557642 | rs10056599 | 0.51 | 0.28 | 1 |
| hCV2084293 | rs3212227 | hCV3169809 | rs730691 | 0.51 | 0.28 | 0.39264 |
| hCV2084293 | rs3212227 | hCV31985582 | rs6556412 | 0.51 | 0.28 | 0.30172 |
| hCV2084293 | rs3212227 | hCV31985592 | rs7709212 | 0.51 | 0.28 | 0.45634 |
| hCV2084293 | rs3212227 | hCV32389155 | rs3213097 | 0.51 | 0.28 | 1 |
| hCV2084293 | rs3212227 | hCV7537829 | rs1433046 | 0.51 | 0.28 | 0.36701 |
| hCV2084293 | rs3212227 | hDV70267720 | rs7719425 | 0.51 | 0.28 | 0.52712 |
| hCV2084293 | rs3212227 | hDV70665567 | rs7709212 | 0.51 | 0.28 | 0.44187 |
| hCV2084293 | rs3212227 | hDV70836263 | rs17056626 | 0.51 | 0.28 | 0.31682 |
| hCV2084293 | rs3212227 | hDV71045748 | rs6894567 | 0.51 | 0.28 | 0.95272 |
| hCV2084293 | rs3212227 | hDV71102154 | rs1473247 | 0.51 | 0.28 | 0.43743 |
| hCV2990018 | rs7530511 | hCV16078411 | rs2863212 | 0.51 | 0.5 | 0.77778 |
| hCV2990018 | rs7530511 | hCV2720226 | rs2863209 | 0.51 | 0.5 | 0.50884 |
| hCV2990018 | rs7530511 | hCV27868367 | rs4655530 | 0.51 | 0.5 | 0.92453 |
| hCV2990018 | rs7530511 | hCV27868368 | rs4655693 | 0.51 | 0.5 | 1 |
| hCV2990018 | rs7530511 | hCV27952715 | rs4655692 | 0.51 | 0.5 | 0.54175 |
| hCV2990018 | rs7530511 | hCV2990003 | rs11804284 | 0.51 | 0.5 | 0.79053 |
| hCV2990018 | rs7530511 | hCV2990015 | rs7528924 | 0.51 | 0.5 | 0.54286 |
| hCV2990018 | rs7530511 | hCV31222825 | rs10889671 | 0.51 | 0.5 | 0.92453 |
| hCV31222786 | rs1857292 | hCV2720226 | rs2863209 | 0.51 | 0.895 | 1 |
| hCV31222825 | rs10889671 | hCV16078411 | rs2863212 | 0.51 | 0.555 | 0.69003 |
| hCV31222825 | rs10889671 | hCV27868367 | rs4655530 | 0.51 | 0.555 | 1 |
| hCV31222825 | rs10889671 | hCV27868368 | rs4655693 | 0.51 | 0.555 | 0.92453 |
| hCV31222825 | rs10889671 | hCV2990003 | rs11804284 | 0.51 | 0.555 | 0.85817 |
| hCV31222825 | rs10889671 | hCV2990018 | rs7530511 | 0.51 | 0.555 | 0.92453 |
| hCV31985592 | rs7709212 | hCV1994971 | rs7725339 | 0.51 | 0.48 | 0.80424 |
| hDV68553886 | rs3212220 | hCV1994971 | rs7725339 | 0.51 | 0.31 | 0.32318 |
| hDV68553886 | rs3212220 | hCV2084255 | rs3734104 | 0.51 | 0.31 | 0.36701 |
| hDV68553886 | rs3212220 | hCV2084281 | rs7730390 | 0.51 | 0.31 | 0.9061 |
| hDV68553886 | rs3212220 | hCV2084293 | rs3212227 | 0.51 | 0.31 | 1 |
| hDV68553886 | rs3212220 | hCV27883435 | rs7381075 | 0.51 | 0.31 | 0.95073 |
| hDV68553886 | rs3212220 | hCV29927086 | rs3213094 | 0.51 | 0.31 | 1 |
| hDV68553886 | rs3212220 | hCV3169809 | rs730691 | 0.51 | 0.31 | 0.39264 |
| hDV68553886 | rs3212220 | hCV31985592 | rs7709212 | 0.51 | 0.31 | 0.45634 |
| hDV68553886 | rs3212220 | hDV70267720 | rs7719425 | 0.51 | 0.31 | 0.52712 |
| hDV68553886 | rs3212220 | hDV71045748 | rs6894567 | 0.51 | 0.31 | 0.95272 |

TABLE 5

IL12B and IL23R region SNPs that are significant in a combined analysis across all three sample sets (odds ratio 95% confidence intervals don't cross 1).

| hCV | dbSNP ID | Gene | Position & Alleles | $OR_{common}$ (95% CI) | $P_{comb}$ |
|---|---|---|---|---|---|
| hCV3220386 | rs270661 | | A158492732G | 1.21 (1.06-1.38) | NC |
| hCV3220380 | rs270654 | | G158497687A | 1.20 (1.01-1.42) | 0.160 |
| hCV2081982 | rs10076782 | FLJ31951 | A158537541G | 0.80 (0.71-0.90) | 0.002 |
| hCV2081970 | rs1897565 | FLJ31951 | C158550843T | 0.79 (0.70-0.89) | 0.001 |
| hCV30377542 | rs6888950 | FLJ31951 | G158557329T | 0.79 (0.70-0.89) | 0.001 |
| hDV70267720 | rs7719425 | | C158603516T | 0.77 (0.68-0.88) | 0.001 |
| hCV7537756 | rs1368437 | UBLCP1 | G158639557C | 1.19 (1.01-1.41) | NC |
| hCV2084270 | rs2082412 | | A158650367G | 0.65 (0.57-0.75) | 9.52E−09 |
| hCV2084281 | rs7730390 | | C158663370T | 0.64 (0.56-0.74) | 2.45E−09 |

TABLE 5-continued

IL12B and IL23R region SNPs that are significant in a combined analysis across all three sample sets (odds ratio 95% confidence intervals don't cross 1).

| hCV | dbSNP ID | Gene | Position & Alleles | $OR_{common}$ (95% CI) | $P_{comb}$ |
|---|---|---|---|---|---|
| hCV7537839 | rs1368439 | IL12B | G158674592T | 1.24 (1.09-1.42) | 0.007 |
| hCV2084293 | rs3212227 | IL12B | C158675528A | 0.64 (0.56-0.73) | 1.66E−09 |
| hCV2084296 | rs2853696 | IL12B | A158677238G | 1.23 (1.08-1.40) | 0.011 |
| hCV2084297 | rs919766 | IL12B | C158680142A | 1.18 (1.00-1.39) | 0.173 |
| hCV2084298 | rs2853694 | IL12B | A158681666C | 0.83 (0.75-0.92) | 0.004 |
| hCV2084301 | rs3213093 | IL12B | A158683557G | 0.65 (0.57-0.75) | 6.51E−09 |
| hDV68553886 | rs3212220 | IL12B | T158686773G | 0.65 (0.56-0.74) | 4.22E−09 |
| hCV27471935 | rs3212217 | IL12B | C158687708G | 0.65 (0.57-0.75) | 4.82E−09 |
| hCV1992693 | rs1433048 | IL12B | G158688423A | 1.22 (1.07-1.39) | 0.020 |
| hDV71045748 | rs6894567 | IL12B | G158689546A | 0.66 (0.58-0.76) | 2.33E−08 |
| hDV70663683 | rs17860508 | IL12B | GC158692778TTAGA | 0.89 (0.81-0.99) | 0.120 |
| hDV70665567 | rs7709212[h] |  | C158696755T | 0.73 (0.65-0.82) | 9.24E−07 |
| hCV1994965 | rs953861[h] |  | G158705160A | 1.27 (1.11-1.45) | 0.004 |
| hCV1994990 | rs6861600 |  | G158752193C | 0.70 (0.62-0.79) | 4.00E−08 |
| hCV29349404 | rs7704367 |  | C158754071A | 0.71 (0.63-0.80) | 1.10E−07 |
| hCV1994992 | rs6887695 |  | C158755223G | 0.71 (0.63-0.79) | 7.02E−08 |
| hCV7538755 | rs918520 |  | C158758888G | 1.29 (1.14-1.46) | 0.001 |
| hCV7538761 | rs1422878 |  | A158771795G | 0.82 (0.73-0.91) | 0.001 |
| hCV1995017 | rs4921496 |  | T158780649C | 1.22 (1.09-1.38) | 0.004 |
| hCV28024675 | rs4921230 |  | T158812974C | 0.81 (0.72-0.92) | 0.010 |
| hCV1272348 | rs6687620 | IL23R | T67421048C | 0.834 (0.704-0.983) | 0.146 |
| hCV2990018 | rs7530511 | IL23R | T67457975C | 0.772 (0.66-0.913) | 0.012 |
| hCV31222838 | rs11465804 | IL23R | G67475114T | 0.628 (0.502-0.795) | 0.00076 |
| hCV31222825 | rs10889671 | IL23R | A67478314G | 0.778 (0.662-0.919) | 0.016 |
| hCV1272298 | rs11209026 | IL23R | A67478546G | 0.621 (0.494-0.777) | 0.00039 |
| hCV2720255 | rs10889674 | IL23R | G67490116T | 1.169 (1.053-1.298) | 0.031 |
| hCV31222786 | rs1857292 |  | T67510910A | 0.777 (0.665-0.917) | 0.020 |
| hCV2720238 | rs11209032 |  | A67512680G | 1.16 (1.037-1.296) | 0.057 |

TABLE 6

Minor allele frequencies and allele-based association of IL12B-associated SNPs with psoriasis[1].

| | | | | Discovery Sample Set | | | | Replication Sample Set 1 | |
|---|---|---|---|---|---|---|---|---|---|
| | | | | Frequency In | | | | Frequency In | |
| SNP Number | dbSNP ID | Gene | Type | Cases (n = 465) | Controls (n = 460) | OR | Allelic P-value[2] | Cases (n = 494) | Controls (n = 495) |
| 1 | rs929779 | EBF | intron | 0.465 | 0.452 | 1.05 | 0.608 | 0.489 | 0.490 |
| 2 | rs1422668 | EBF | intron | 0.311 | 0.324 | 0.94 | 0.582 | 0.344 | 0.336 |
| 3 | rs6898290 | EBF | intron | 0.415 | 0.413 | 1.01 | 0.925 | 0.452 | 0.442 |
| 4 | rs2161357 | | intergenic | 0.194 | 0.215 | 0.88 | 0.273 | 0.217 | 0.198 |
| 5 | rs6897374 | | intergenic | 0.089 | 0.074 | 1.22 | 0.236 | 0.084 | 0.102 |
| 6 | rs6896438 | | intergenic | 0.391 | 0.400 | 0.97 | 0.739 | 0.398 | 0.393 |
| 7 | rs270661 | | intergenic | 0.197 | 0.200 | 0.98 | 0.907 | 0.235 | 0.183 |
| 8 | rs270654 | | intergenic | 0.109 | 0.103 | 1.07 | 0.705 | 0.136 | 0.109 |
| 9 | rs6556398 | | intergenic | 0.321 | 0.304 | 1.08 | 0.451 | 0.295 | 0.320 |
| 10 | rs717925 | | intergenic | 0.014 | 0.015 | 0.91 | 0.848 | 0.010 | 0.028 |
| 11 | rs10035989 | FLJ31951 | UTR | 0.199 | 0.189 | 1.06 | 0.597 | 0.193 | 0.185 |
| 12 | rs2043270 | FLJ31951 | intron | 0.088 | 0.075 | 1.19 | 0.310 | 0.081 | 0.071 |
| 13 | rs10076782 | FLJ31951 | intron | 0.214 | 0.271 | 0.73 | 0.005 | 0.244 | 0.283 |
| 14 | rs1897565 | FLJ31951 | intron | 0.212 | 0.273 | 0.71 | 0.002 | 0.243 | 0.280 |
| 15 | rs6888950 | FLJ31951 | intron | 0.213 | 0.273 | 0.72 | 0.003 | 0.241 | 0.279 |
| 16 | rs7721001 | | intergenic | 0.417 | 0.466 | 0.82 | 0.035 | 0.479 | 0.469 |
| 17 | rs7719425 | | intergenic | 0.157 | 0.204 | 0.73 | 0.011 | 0.186 | 0.229 |
| 18 | rs11744690 | | intergenic | 0.344 | 0.329 | 1.07 | 0.520 | 0.323 | 0.305 |
| 19 | rs1368437 | UBLCP1 | intron | 0.118 | 0.094 | 1.30 | 0.096 | 0.129 | 0.101 |
| 20 | rs2082412 | | intergenic | 0.145 | 0.207 | 0.65 | 4.77E−04 | 0.143 | 0.222 |
| 21 | rs7730390 | | intergenic | 0.144 | 0.210 | 0.63 | 2.39E−04 | 0.142 | 0.224 |
| 22 | rs3181225 | | intergenic | 0.188 | 0.177 | 1.08 | 0.546 | 0.174 | 0.178 |
| 23 | rs1368439 | IL12B | UTR | 0.204 | 0.191 | 1.08 | 0.519 | 0.227 | 0.183 |
| 24 | rs3212227 | IL12B | UTR | 0.143 | 0.209 | 0.63 | 2.38E−04 | 0.139 | 0.224 |
| 25 | rs3213120 | IL12B | UTR | 0.030 | 0.027 | 1.12 | 0.781 | 0.031 | 0.040 |
| 26 | rs3213119 | IL12B | F298V | 0.031 | 0.027 | 1.15 | 0.679 | 0.030 | 0.039 |
| 27 | rs2853696 | IL12B | intron | 0.205 | 0.193 | 1.08 | 0.521 | 0.228 | 0.183 |
| 28 | rs3213102 | IL12B | intron | 0.026 | 0.027 | 0.95 | 0.886 | 0.014 | 0.019 |
| 29 | rs919766 | IL12B | intron | 0.119 | 0.099 | 1.23 | 0.179 | 0.135 | 0.107 |
| 30 | rs2853694 | IL12B | intron | 0.449 | 0.482 | 0.87 | 0.160 | 0.450 | 0.508 |
| 31 | rs3213096 | IL12B | I33V | 0.000 | 0.003 | NC | 0.123 | 0.002 | 0.000 |

TABLE 6-continued

Minor allele frequencies and allele-based association of IL12B-associated SNPs with psoriasis[1].

| | | | | | | | | | |
|---|---|---|---|---|---|---|---|---|---|
| 32 | rs3213093 | IL12B | intron | 0.143 | 0.207 | 0.64 | 3.63E−04 | 0.143 | 0.223 |
| 33 | rs2569253 | IL12B | intron | 0.531 | 0.499 | 1.14 | 0.177 | 0.494 | 0.485 |
| 34 | rs3212220 | IL12B | intron | 0.144 | 0.207 | 0.65 | 4.76E−04 | 0.143 | 0.226 |
| 35 | rs3212217 | IL12B | intron | 0.145 | 0.208 | 0.65 | 3.90E−04 | 0.141 | 0.224 |
| 36 | rs2546892 | IL12B | intron | 0.161 | 0.156 | 1.04 | 0.799 | 0.149 | 0.148 |
| 37 | rs1433048 | IL12B | intron | 0.213 | 0.185 | 1.19 | 0.145 | 0.212 | 0.189 |
| 38 | rs6894567 | IL12B | intron | 0.154 | 0.208 | 0.69 | 0.002 | 0.134 | 0.217 |
| 39 | rs17860508 | IL12B | promotor | 0.449 | 0.482 | 0.87 | 0.160 | 0.469 | 0.514 |
| 40 | rs7709212 | | intergenic | 0.274 | 0.336 | 0.75 | 0.005 | 0.268 | 0.351 |
| 41 | rs953861 | | intergenic | 0.189 | 0.170 | 1.14 | 0.276 | 0.221 | 0.181 |
| 42 | rs6869411 | | intergenic | 0.390 | 0.388 | 1.01 | 0.962 | 0.355 | 0.338 |
| 43 | rs1833754 | | intergenic | 0.042 | 0.052 | 0.79 | 0.323 | 0.047 | 0.061 |
| 44 | rs6861600 | | intergenic | 0.255 | 0.321 | 0.72 | 0.002 | 0.242 | 0.331 |
| 45 | rs7704367 | | intergenic | 0.256 | 0.321 | 0.73 | 0.002 | 0.245 | 0.330 |
| 46 | rs6887695 | | intergenic | 0.255 | 0.319 | 0.73 | 0.002 | 0.243 | 0.332 |
| 47 | rs918520 | | intergenic | 0.253 | 0.203 | 1.33 | 0.011 | 0.247 | 0.217 |
| 48 | rs4921226 | | intergenic | 0.317 | 0.340 | 0.90 | 0.296 | 0.363 | 0.330 |
| 49 | rs1422878 | | intergenic | 0.355 | 0.369 | 0.94 | 0.529 | 0.298 | 0.373 |
| 50 | rs4921496 | | intergenic | 0.275 | 0.249 | 1.14 | 0.224 | 0.293 | 0.265 |
| 51 | rs4921230 | | intergenic | 0.228 | 0.253 | 0.88 | 0.231 | 0.210 | 0.260 |

| | Replication Sample Set 1 | | Replication Sample Set 2 Frequency In | | | | Combined Analysis | |
|---|---|---|---|---|---|---|---|---|
| SNP Number | OR | Allelic P-value[2] | Cases (n = 481) | Controls (n = 424) | OR | Allelic P-value[2] | $OR_{common}$ (95% CI)[3] | $P_{comb}$[4] |
| 1 | 1.00 | 0.964 | 0.513 | 0.471 | 1.18 | 0.082 | 1.07 (0.96-1.19) | 0.414 |
| 2 | 1.03 | 0.740 | 0.339 | 0.331 | 1.03 | 0.765 | 1.00 (0.90-1.12) | NC |
| 3 | 1.04 | 0.651 | 0.444 | 0.458 | 0.95 | 0.570 | 1.00 (0.90-1.11) | NC |
| 4 | 1.12 | 0.318 | 0.191 | 0.196 | 0.97 | 0.811 | 0.99 (0.87-1.13) | NC |
| 5 | 0.80 | 0.163 | 0.085 | 0.103 | 0.81 | 0.197 | 0.91 (0.76-1.09) | NC |
| 6 | 1.02 | 0.854 | 0.382 | 0.413 | 0.88 | 0.179 | 0.95 (0.86-1.06) | NC |
| 7 | 1.37 | 0.005 | 0.213 | 0.173 | 1.30 | 0.032 | 1.21 (1.06-1.38) | NC |
| 8 | 1.29 | 0.074 | 0.111 | 0.092 | 1.23 | 0.187 | 1.20 (1.01-1.42) | 0.160 |
| 9 | 0.89 | 0.223 | 0.299 | 0.307 | 0.97 | 0.759 | 0.97 (0.87-1.09) | NC |
| 10 | 0.35 | 0.005 | 0.020 | 0.016 | 1.20 | 0.725 | 0.71 (0.47-1.06) | NC |
| 11 | 1.06 | 0.646 | 0.180 | 0.187 | 0.96 | 0.761 | 1.03 (0.90-1.17) | NC |
| 12 | 1.16 | 0.397 | 0.077 | 0.070 | 1.10 | 0.653 | 1.15 (0.95-1.40) | 0.538 |
| 13 | 0.82 | 0.058 | 0.252 | 0.285 | 0.84 | 0.123 | 0.80 (0.71-0.90) | 0.002 |
| 14 | 0.83 | 0.065 | 0.248 | 0.284 | 0.84 | 0.099 | 0.79 (0.70-0.89) | 0.001 |
| 15 | 0.82 | 0.057 | 0.248 | 0.283 | 0.84 | 0.098 | 0.79 (0.70-0.89) | 0.001 |
| 16 | 1.04 | 0.685 | 0.460 | 0.466 | 0.98 | 0.814 | 0.94 (0.85-1.05) | NC |
| 17 | 0.77 | 0.023 | 0.205 | 0.242 | 0.81 | 0.062 | 0.77 (0.68-0.88) | 0.001 |
| 18 | 1.09 | 0.410 | 0.335 | 0.326 | 1.04 | 0.689 | 1.07 (0.95-1.19) | 0.699 |
| 19 | 1.31 | 0.057 | 0.105 | 0.107 | 0.98 | 0.939 | 1.19 (1.01-1.41) | NC |
| 20 | 0.59 | 6.43E−06 | 0.166 | 0.215 | 0.73 | 0.010 | 0.65 (0.57-0.75) | 9.52E−09 |
| 21 | 0.57 | 2.89E−06 | 0.167 | 0.215 | 0.73 | 0.010 | 0.64 (0.56-0.74) | 2.45E−09 |
| 22 | 0.97 | 0.859 | 0.166 | 0.170 | 0.97 | 0.850 | 1.01 (0.88-1.16) | NC |
| 23 | 1.31 | 0.016 | 0.219 | 0.174 | 1.33 | 0.018 | 1.24 (1.09-1.42) | 0.007 |
| 24 | 0.56 | 1.38E−06 | 0.167 | 0.214 | 0.74 | 0.014 | 0.64 (0.56-0.73) | 1.66E−09 |
| 25 | 0.76 | 0.273 | 0.026 | 0.036 | 0.73 | 0.273 | 0.84 (0.62-1.14) | NC |
| 26 | 0.76 | 0.327 | 0.027 | 0.035 | 0.76 | 0.342 | 0.86 (0.64-1.17) | NC |
| 27 | 1.31 | 0.016 | 0.217 | 0.175 | 1.31 | 0.029 | 1.23 (1.08-1.40) | 0.011 |
| 28 | 0.73 | 0.387 | 0.024 | 0.035 | 0.67 | 0.163 | 0.78 (0.55-1.10) | 0.450 |
| 29 | 1.30 | 0.062 | 0.113 | 0.113 | 1.00 | 1.000 | 1.18 (1.00-1.39) | 0.173 |
| 30 | 0.79 | 0.010 | 0.447 | 0.494 | 0.83 | 0.048 | 0.83 (0.75-0.92) | 0.004 |
| 31 | NC | 0.248 | 0.000 | 0.000 | NC | NC | NC | NC |
| 32 | 0.58 | 3.95E−06 | 0.167 | 0.212 | 0.74 | 0.014 | 0.65 (0.57-0.75) | 6.51E−09 |
| 33 | 0.96 | 0.686 | 0.500 | 0.498 | 1.01 | 0.925 | 1.06 (0.95-1.18) | NC |
| 34 | 0.57 | 1.89E−06 | 0.167 | 0.212 | 0.74 | 0.014 | 0.65 (0.56-0.74) | 4.22E−09 |
| 35 | 0.57 | 1.62E−06 | 0.169 | 0.212 | 0.76 | 0.023 | 0.65 (0.57-0.75) | 4.82E−09 |
| 36 | 1.00 | 1.000 | 0.140 | 0.147 | 0.95 | 0.688 | 1.00 (0.86-1.16) | NC |
| 37 | 1.15 | 0.216 | 0.228 | 0.181 | 1.33 | 0.017 | 1.22 (1.07-1.39) | 0.020 |
| 38 | 0.56 | 1.11E−06 | 0.165 | 0.205 | 0.76 | 0.029 | 0.66 (0.58-0.76) | 2.33E−08 |
| 39 | 0.83 | 0.043 | 0.469 | 0.472 | 0.99 | 0.925 | 0.89 (0.81-0.99) | 0.120 |
| 40 | 0.68 | 8.07E−05 | 0.276 | 0.332 | 0.77 | 0.010 | 0.73 (0.65-0.82) | 9.24E−07 |
| 41 | 1.28 | 0.029 | 0.202 | 0.154 | 1.40 | 0.008 | 1.27 (1.11-1.45) | 0.004 |
| 42 | 1.08 | 0.447 | 0.372 | 0.374 | 0.99 | 0.922 | 1.03 (0.92-1.15) | NC |
| 43 | 0.76 | 0.194 | 0.059 | 0.055 | 1.08 | 0.762 | 0.87 (0.69-1.10) | NC |
| 44 | 0.64 | 1.16E−05 | 0.249 | 0.306 | 0.75 | 0.007 | 0.70 (0.62-0.79) | 4.00E−08 |
| 45 | 0.66 | 2.90E−05 | 0.251 | 0.308 | 0.75 | 0.007 | 0.71 (0.63-0.80) | 1.10E−07 |
| 46 | 0.65 | 1.49E−05 | 0.251 | 0.308 | 0.75 | 0.007 | 0.71 (0.83-0.79) | 7.02E−08 |
| 47 | 1.19 | 0.122 | 0.255 | 0.200 | 1.37 | 0.005 | 1.29 (1.14-1.46) | 0.001 |
| 48 | 1.15 | 0.137 | 0.347 | 0.355 | 0.96 | 0.693 | 1.00 (0.90-1.12) | NC |
| 49 | 0.71 | 3.54E−04 | 0.299 | 0.340 | 0.83 | 0.062 | 0.82 (0.73-0.91) | 0.001 |

TABLE 6-continued

Minor allele frequencies and allele-based association of IL12B-associated SNPs with psoriasis[1].

| 50 | 1.15 | 0.176 | 0.294 | 0.228 | 1.41 | 0.002 | 1.22 (1.09-1.38) | 0.004 |
| 51 | 0.75 | 0.009 | 0.188 | 0.219 | 0.82 | 0.101 | 0.81 (0.72-0.92) | 0.010 |

[1]Data may differ slightly from that reported in Cargill et al. 2007 due to lack of DNA for a small number of samples. SNPs are listed in order according to their position in the genomic contig NT_23133 (Entrez Nucleotide).
[2]Calculated using Fisher's exact test.
[3]Calculated using a Mantel-Haenszel common odds ratio (OR).
[4]Calculated using Fisher's combined test. Combined P-values were not calculated (NC) for SNPs where the ORs for the three samples sets are both above and below 1.

TABLE 7

Minor allele frequencies and allele-based association of IL23R-associated SNPs with psoriasis[1].

| | | | | | Sample Set 1 | | | | Sample Set 2 |
|---|---|---|---|---|---|---|---|---|---|
| | | | | | Frequency in | | | Allelic | Frequency in |
| hCV | Marker | Gene | Type | Position & Alleles[2] | Cases (n = 465) | Controls (n = 460) | OR | P-value[3] | Cases (n = 498) |
| hCV30135285 | rs6685003 | C1orf141 | intron | G67360618T | 0.046 | 0.048 | 0.95 | 0.809 | 0.042 |
| hCV3249086 | rs11209002 | C1orf141 | intron | T67363049C | 0.181 | 0.195 | 0.91 | 0.434 | 0.158 |
| hCV1272378 | rs4655683 | | intergenic | A67384201G | 0.347 | 0.336 | 1.05 | 0.614 | 0.387 |
| hCV11728603 | rs1884444 | IL23R | H3Q | G67406400T | 0.451 | 0.477 | 0.90 | 0.251 | 0.503 |
| hCV1272351 | rs1358749 | IL23R | intron | A67409858G | 0.105 | 0.135 | 0.75 | 0.051 | 0.112 |
| hCV1272348 | rs6687620 | IL23R | intron | T67421048C | 0.104 | 0.132 | 0.77 | 0.066 | 0.106 |
| hCV31222894 | rs11465791 | IL23R | intron | A67422084G | 0.059 | 0.066 | 0.89 | 0.562 | 0.060 |
| hCV1272335 | rs12401432 | IL23R | intron | G67429519C | 0.309 | 0.298 | 1.05 | 0.605 | 0.346 |
| hCV11283730 | rs4655688 | IL23R | intron | C67430570T | 0.105 | 0.136 | 0.75 | 0.043 | 0.113 |
| hCV31222889 | rs12562213 | IL23R | intron | T67431357C | 0.040 | 0.040 | 1.00 | 0.960 | 0.045 |
| hCV1272330 | rs10489630 | IL23R | intron | G67435210T | 0.415 | 0.417 | 0.99 | 0.931 | 0.435 |
| hCV8906845 | rs1569922 | IL23R | intron | T67437551C | 0.417 | 0.406 | 1.05 | 0.635 | 0.433 |
| hCV8906837 | rs1321150 | IL23R | intron | T67443012C | 0.240 | 0.263 | 0.89 | 0.259 | 0.238 |
| hCV1272311 | rs790631 | IL23R | intron | C67449510T | 0.238 | 0.263 | 0.87 | 0.206 | 0.235 |
| hCV2990025 | rs790632 | IL23R | intron | C67451510A | 0.240 | 0.261 | 0.89 | 0.294 | 0.226 |
| hCV30369702 | rs7517847 | IL23R | intron | G67454257T | 0.449 | 0.438 | 1.05 | 0.631 | 0.446 |
| hCV2990018 | rs7530511 | IL23R | L310P | T67457975C | 0.104 | 0.146 | 0.67 | 0.006 | 0.100 |
| hCV30279129 | rs10489629 | IL23R | intron | G67460937A | 0.457 | 0.458 | 0.99 | 0.939 | 0.467 |
| hCV27952715 | rs4655692 | IL23R | intron | A67464253G | 0.216 | 0.245 | 0.85 | 0.143 | 0.207 |
| hCV1272302 | rs2201841 | IL23R | intron | C67466790T | 0.328 | 0.298 | 1.15 | 0.173 | 0.326 |
| hCV31222838 | rs11465804 | IL23R | intron | G67475114T | 0.039 | 0.058 | 0.66 | 0.062 | 0.059 |
| hCV11283754 | rs10489628 | IL23R | intron | T67476695C | 0.421 | 0.404 | 1.07 | 0.457 | 0.408 |
| hCV2989999 | rs1343152 | IL23R | intron | C67476920A | 0.364 | 0.355 | 1.04 | 0.677 | 0.386 |
| hCV31222826 | rs10789229 | IL23R | intron | C67478162T | 0.374 | 0.423 | 0.81 | 0.032 | 0.398 |
| hCV31222825 | rs10889671 | IL23R | intron | A67478314G | 0.102 | 0.143 | 0.68 | 0.008 | 0.102 |
| hCV1272298 | rs11209026 | IL23R | Q381R | A67478546G | 0.043 | 0.060 | 0.71 | 0.107 | 0.059 |
| hCV2720255 | rs10889674 | IL23R | intron | G67490116T | 0.438 | 0.392 | 1.21 | 0.047 | 0.433 |
| hCV31222811 | rs12085634 | IL23R | intron | A67491301T | 0.104 | 0.093 | 1.13 | 0.433 | 0.101 |
| hCV8367043 | rs1343151 | IL23R | intron | T67491717C | 0.320 | 0.339 | 0.92 | 0.381 | 0.358 |
| hCV8367042 | rs1008193 | IL23R | intron | C67492499G | 0.271 | 0.276 | 0.97 | 0.786 | 0.290 |
| hCV30243123 | rs6693831 | IL23R | intron | T67493455C | 0.246 | 0.270 | 0.88 | 0.241 | 0.214 |
| hCV261080 | rs10889675 | IL23R | intron | A67494804C | 0.145 | 0.126 | 1.18 | 0.222 | 0.111 |
| hCV31222798 | rs11465827 | IL23R | 3'UTR | G67497416T | 0.005 | 0.004 | 1.24 | 0.746 | 0.009 |
| hCV11283764 | rs10889677 | IL23R | 3'UTR | A67497708C | 0.325 | 0.297 | 1.14 | 0.206 | 0.327 |
| hCV2720250 | rs4655531 | | intergenic | T67500366C | 0.145 | 0.124 | 1.19 | 0.200 | 0.112 |
| hCV26465573 | rs11209030 | | intergenic | A67510363C | 0.255 | 0.267 | 0.94 | 0.556 | 0.268 |
| hCV31222786 | rs1857292 | | intergenic | T67510910A | 0.107 | 0.139 | 0.74 | 0.033 | 0.105 |
| hCV31222784 | rs11209031 | | intergenic | C67512176A | 0.260 | 0.268 | 0.96 | 0.686 | 0.271 |
| hCV2720238 | rs11209032 | | intergenic | A67512680G | 0.339 | 0.304 | 1.18 | 0.103 | 0.340 |
| hCV3277193 | rs12141431 | | intergenic | C67519611G | 0.300 | 0.279 | 1.11 | 0.328 | 0.311 |
| hCV8361864 | rs1495965 | | intergenic | G67526096A | 0.448 | 0.435 | 1.05 | 0.597 | 0.441 |
| hCV26465558 | rs11578380 | | intergenic | G67533953C | 0.437 | 0.429 | 1.03 | 0.728 | 0.436 |
| hCV2694787 | rs12131065 | | | A67541594G | 0.239 | 0.240 | 0.99 | 0.947 | 0.220 |
| hCV11728631 | rs2001257 | IL12RB2 | intron | G67550178C | 0.039 | 0.038 | 1.02 | 0.921 | 0.039 |
| hCV11728636 | rs2066445 | IL12RB2 | intron | A67554563G | 0.192 | 0.188 | 1.02 | 0.864 | 0.172 |
| hCV8367041 | rs1495964 | IL12RB2 | intron | C67567406T | 0.418 | 0.419 | 0.99 | 0.936 | 0.410 |
| hCV3277169 | rs1495963 | IL12RB2 | S238S | A67577907G | 0.010 | 0.023 | 0.42 | 0.026 | 0.016 |
| hCV29129912 | rs6679356 | IL12RB2 | intron | C67592782T | 0.182 | 0.179 | 1.02 | 0.859 | 0.192 |
| hCV26465525 | rs2307153 | IL12RB2 | D465G | A67606231G | 0.016 | 0.025 | 0.64 | 0.181 | 0.017 |
| hCV27517014 | rs3790568 | IL12RB2 | intron | A67608648G | 0.046 | 0.049 | 0.93 | 0.734 | 0.052 |
| hCV22275265 | rs4297265 | IL12RB2 | T643T | G67624923A | 0.432 | 0.423 | 1.04 | 0.701 | 0.421 |
| hCV12104810 | rs1874396 | IL12RB2 | 3'UTR | C67635054A | 0.010 | 0.025 | 0.38 | 0.012 | 0.014 |
| hCV8366984 | rs1109918 | IL12RB2 | 3'UTR | C67635070T | 0.026 | 0.024 | 1.08 | 0.793 | 0.026 |
| hCV2694742 | rs1948526 | | intergenic | T67645934G | 0.035 | 0.045 | 0.77 | 0.270 | 0.028 |
| hCV28017716 | rs4655707 | SERBP1 | 3'UTR | T67648002C | 0.433 | 0.421 | 1.05 | 0.623 | 0.421 |
| hCV2694741 | rs4655708 | SERBP1 | 3'UTR | A67648121T | 0.432 | 0.422 | 1.04 | 0.666 | 0.421 |

TABLE 7-continued

Minor allele frequencies and allele-based association of IL23R-associated SNPs with psoriasis[1].

| hCV | rs | Gene | Region | Position | Freq1 | Freq2 | OR | P | P2 |
|---|---|---|---|---|---|---|---|---|---|
| hCV2694740 | rs1058074 | SERBP1 | 3'UTR | G67649072A | 0.344 | 0.352 | 0.97 | 0.717 | 0.334 |
| hDV70954502 | rs17446753 | | intergenic | G67678660C | 0.065 | 0.056 | 1.18 | 0.404 | 0.062 |
| hCV78070 | rs12138671 | | intergenic | G67690502A | 0.473 | 0.481 | 0.97 | 0.718 | 0.493 |
| hCV8362705 | rs1340590 | | intergenic | G67696878A | 0.290 | 0.287 | 1.01 | 0.898 | 0.277 |
| hCV8362706 | rs1340589 | | intergenic | T67696979C | 0.175 | 0.153 | 1.18 | 0.193 | 0.145 |

| | Sample Set 2 | | | Sample Set 3 | | | | | |
|---|---|---|---|---|---|---|---|---|---|
| | Frequency in | | Allelic | Frequency in | | | Allelic | | |
| | Controls | | P- | Cases | Controls | | P- | Combined Analysis | | |
| hCV | (n = 498) | OR | value[3] | (n = 481) | (n = 424) | OR | value[3] | OR$_{common}$ (95% CI)[4] | P$_{comb}$[5] |
| hCV30135285 | 0.045 | 0.93 | 0.741 | 0.053 | 0.043 | 1.23 | 0.382 | 1.035 (0.811-1.334) | |
| hCV3249086 | 0.170 | 0.92 | 0.503 | 0.171 | 0.168 | 1.02 | 0.900 | 0.95 (0.823-1.081) | |
| hCV1272378 | 0.338 | 1.24 | 0.025 | 0.351 | 0.354 | 0.98 | 0.883 | 1.082 (0.978-1.216) | |
| hCV11728603 | 0.461 | 1.18 | 0.065 | 0.468 | 0.473 | 1.02 | 0.851 | 1.009 (0.918-1.131) | |
| hCV1272351 | 0.120 | 0.93 | 0.621 | 0.109 | 0.119 | 0.91 | 0.506 | 0.858 (0.725-1.01) | 0.218 |
| hCV1272348 | 0.121 | 0.86 | 0.321 | 0.103 | 0.115 | 0.88 | 0.407 | 0.834 (0.704-0.983) | 0.146 |
| hCV31222894 | 0.064 | 0.94 | 0.779 | 0.066 | 0.060 | 1.11 | 0.630 | 0.979 (0.78-1.205) | |
| hCV1272335 | 0.302 | 1.22 | 0.039 | 0.318 | 0.304 | 1.07 | 0.510 | 1.112 (0.998-1.247) | 0.181 |
| hCV11283730 | 0.120 | 0.94 | 0.674 | 0.110 | 0.119 | 0.92 | 0.605 | 0.861 (0.733-1.014) | 0.232 |
| hCV31222889 | 0.040 | 1.13 | 0.654 | 0.040 | 0.046 | 0.88 | 0.643 | 0.992 (0.769-1.296) | |
| hCV1272330 | 0.423 | 1.05 | 0.616 | 0.410 | 0.419 | 0.97 | 0.738 | 1.001 (0.901-1.115) | |
| hCV8906845 | 0.425 | 1.04 | 0.716 | 0.413 | 0.419 | 0.97 | 0.812 | 1.018 (0.916-1.132) | |
| hCV8906837 | 0.251 | 0.93 | 0.529 | 0.235 | 0.246 | 0.94 | 0.621 | 0.919 (0.813-1.038) | 0.553 |
| hCV1272311 | 0.251 | 0.92 | 0.431 | 0.235 | 0.244 | 0.95 | 0.700 | 0.913 (0.811-1.031) | 0.474 |
| hCV2990025 | 0.251 | 0.87 | 0.224 | 0.232 | 0.238 | 0.97 | 0.824 | 0.913 (0.805-1.023) | 0.443 |
| hCV30369702 | 0.446 | 1.00 | 1.000 | 0.421 | 0.434 | 0.95 | 0.568 | 0.997 (0.899-1.11) | |
| hCV2990018 | 0.114 | 0.86 | 0.345 | 0.108 | 0.131 | 0.81 | 0.146 | 0.772 (0.66-0.913) | 0.012 |
| hCV30279129 | 0.475 | 0.97 | 0.752 | 0.448 | 0.460 | 0.95 | 0.637 | 0.973 (0.875-1.080) | 0.953 |
| hCV27952715 | 0.213 | 0.97 | 0.782 | 0.209 | 0.222 | 0.92 | 0.493 | 0.91 (0.805-1.037) | 0.446 |
| hCV1272302 | 0.310 | 1.07 | 0.468 | 0.343 | 0.319 | 1.12 | 0.294 | 1.113 (0.995-1.243) | 0.279 |
| hCV31222838 | 0.082 | 0.70 | 0.043 | 0.036 | 0.067 | 0.53 | 0.004 | 0.628 (0.502-0.795) | 0.00076 |
| hCV11283754 | 0.389 | 1.08 | 0.408 | 0.411 | 0.392 | 1.08 | 0.443 | 1.078 (0.973-1.200) | 0.545 |
| hCV2989999 | 0.395 | 0.96 | 0.712 | 0.380 | 0.383 | 0.99 | 0.923 | 0.997 (0.892-1.111) | |
| hCV31222826 | 0.393 | 1.02 | 0.817 | 0.392 | 0.398 | 0.97 | 0.809 | 0.931 (0.841-1.041) | |
| hCV31222825 | 0.113 | 0.89 | 0.467 | 0.108 | 0.133 | 0.79 | 0.111 | 0.778 (0.662-0.919) | 0.016 |
| hCV1272298 | 0.089 | 0.64 | 0.012 | 0.035 | 0.066 | 0.52 | 0.003 | 0.621 (0.494-0.777) | 0.00039 |
| hCV2720255 | 0.404 | 1.12 | 0.217 | 0.444 | 0.405 | 1.17 | 0.096 | 1.169 (1.053-1.298) | 0.031 |
| hCV31222811 | 0.089 | 1.16 | 0.357 | 0.098 | 0.086 | 1.15 | 0.416 | 1.147 (0.959-1.368) | 0.483 |
| hCV8367043 | 0.373 | 0.94 | 0.513 | 0.327 | 0.329 | 0.99 | 0.960 | 0.95 (0.849-1.059) | 0.764 |
| hCV8367042 | 0.278 | 1.06 | 0.583 | 0.284 | 0.257 | 1.15 | 0.204 | 1.057 (0.94-1.193) | |
| hCV30243123 | 0.225 | 0.94 | 0.586 | 0.232 | 0.265 | 0.84 | 0.114 | 0.882 (0.782-1.001) | 0.220 |
| hCV261080 | 0.108 | 1.04 | 0.829 | 0.126 | 0.129 | 0.97 | 0.833 | 1.061 (0.904-1.243) | |
| hCV31222798 | 0.006 | 1.50 | 0.606 | 0.004 | 0.007 | 0.59 | 0.530 | 1.052 (0.529-2.244) | |
| hCV11283764 | 0.310 | 1.08 | 0.439 | 0.342 | 0.319 | 1.11 | 0.318 | 1.109 (0.991-1.241) | 0.312 |
| hCV2720250 | 0.108 | 1.04 | 0.829 | 0.125 | 0.132 | 0.94 | 0.725 | 1.055 (0.900-1.238) | |
| hCV26465573 | 0.253 | 1.09 | 0.441 | 0.289 | 0.251 | 1.22 | 0.071 | 1.076 (0.951-1.208) | |
| hCV31222786 | 0.124 | 0.83 | 0.203 | 0.104 | 0.130 | 0.77 | 0.079 | 0.777 (0.665-0.917) | 0.020 |
| hCV31222784 | 0.254 | 1.09 | 0.412 | 0.286 | 0.252 | 1.19 | 0.112 | 1.076 (0.954-1.212) | |
| hCV2720238 | 0.305 | 1.17 | 0.101 | 0.357 | 0.329 | 1.13 | 0.216 | 1.16 (1.037-1.296) | 0.057 |
| hCV3277193 | 0.281 | 1.15 | 0.166 | 0.317 | 0.298 | 1.10 | 0.386 | 1.116 (0.997-1.255) | 0.259 |
| hCV8361864 | 10.428 | 1.06 | 0.583 | 0.458 | 0.461 | 0.99 | 0.925 | 1.031 (0.930-1.145) | |
| hCV26465558 | 0.417 | 1.08 | 0.387 | 0.449 | 0.450 | 1.00 | 1.000 | 1.036 (0.935-1.149) | 0.865 |
| hCV2694787 | 0.247 | 0.86 | 0.166 | 0.240 | 0.236 | 1.02 | 0.912 | 0.957 (0.844-1.076) | |
| hCV11728631 | 0.047 | 0.84 | 0.439 | 0.039 | 0.063 | 0.59 | 0.018 | 0.777 (0.607-1.009) | |
| hCV11728636 | 0.178 | 0.96 | 0.767 | 0.171 | 0.210 | 0.78 | 0.036 | 0.91 (0.799-1.047) | |
| hCV8367041 | 0.413 | 0.99 | 0.891 | 0.400 | 0.428 | 0.89 | 0.251 | 0.955 (0.862-1.067) | 0.793 |
| hCV3277169 | 0.018 | 0.89 | 0.733 | 0.020 | 0.022 | 0.88 | 0.744 | 0.713 (0.481-1.079) | 0.205 |
| hCV29129912 | 0.191 | 1.01 | 0.954 | 0.178 | 0.194 | 0.90 | 0.431 | 0.975 (0.853-1.116) | |
| hCV26465525 | 0.027 | 0.62 | 0.130 | 0.020 | 0.019 | 1.05 | 1.000 | 0.746 (0.499-1.069) | |
| hCV27517014 | 0.054 | 0.96 | 0.920 | 0.053 | 0.053 | 1.00 | 1.000 | 0.964 (0.76-1.227) | 0.992 |
| hCV22275265 | 0.439 | 0.93 | 0.439 | 0.420 | 0.441 | 0.92 | 0.367 | 0.96 (0.864-1.064) | |
| hCV12104810 | 0.015 | 0.92 | 0.854 | 0.022 | 0.023 | 0.93 | 0.875 | 0.709 (0.48-1.084) | 0.150 |
| hCV8366984 | 0.036 | 0.73 | 0.245 | 0.023 | 0.026 | 0.88 | 0.760 | 0.879 (0.626-1.189) | |
| hCV2694742 | 0.042 | 0.67 | 0.112 | 0.038 | 0.039 | 0.97 | 0.903 | 0.801 (0.598-1.036) | 0.303 |
| hCV28017716 | 0.439 | 0.93 | 0.439 | 0.419 | 0.438 | 0.93 | 0.447 | 0.967 (0.872-1.072) | |
| hCV2694741 | 0.439 | 0.93 | 0.439 | 0.421 | 0.440 | 0.93 | 0.420 | 0.964 (0.868-1.071) | |
| hCV2694740 | 0.336 | 0.99 | 0.924 | 0.329 | 0.340 | 0.95 | 0.618 | 0.968 (0.868-1.081) | 0.938 |
| hDV70954502 | 0.078 | 0.78 | 0.158 | 0.068 | 0.085 | 0.79 | 0.182 | 0.884 (0.715-1.079) | |
| hCV78070 | 0.490 | 1.01 | 0.893 | 0.485 | 0.491 | 0.98 | 0.851 | 0.985 (0.888-1.094) | |

TABLE 7-continued

Minor allele frequencies and allele-based association of IL23R-associated SNPs with psoriasis[1].

| | | | | | | | | |
|---|---|---|---|---|---|---|---|---|
| hCV8362705 | 0.296 | 0.91 | 0.370 | 0.297 | 0.294 | 1.01 | 0.918 | 0.981 (0.873-1.096) |
| hCV8362706 | 0.159 | 0.90 | 0.415 | 0.147 | 0.154 | 0.95 | 0.693 | 1.006 (0.864-1.156) |

[1]Data may differ slightly from that reported in Cargill et al. 2007 due to lack of DNA for a small number of samples.
[2]DNPs are listed in order according to their position in the genomic contig NT_032977. The minor allele is listed first, followed by the position in Genome Build 36.2 and then the major allele.
[3]Calculated using Fisher's exact test.
[4]Calculated using a Mantel-Haenszel common OR.
[5]Calculated using Fisher's combined test.

TABLE 8

Demographic, clinical and pooling information[1].

| Subphenotype | Discovery Sample Set[2] Information | Replication Sample Set 1[3] Information |
|---|---|---|
| Genetic background | White - Utah | White - U.S. |
| # Cases | 467 | 498 |
| # Controls | 500 | 498 |
| Female:male gender ratio | 1.2 | 1.2 |
| Average age of onset | 28 +/− 17 years | 29 +/− 15 years |
| Age of onset (<18 yrs/18-32 yrs/>32 yrs) | 142/169/156 | 125/171/202 |
| Percent with family history | 62.70% | 46.60% |
| Family History (yes/no) | 292/175 | 232/265 |
| Psoriasis worsens after infection (yes/no)[6] | 72/376 | 111/384 |
| % Body surface covered at worst (>13%/<13%) | 186/281 | 113/274 |
| Psoriatic arthiritis and psoriasis for at least 10 years (yes/no) | 125/239 | 98/143 |
| Plaque thickness when no treatment (thick/thin) | 127/110 | — |
| Thick plaque when no treatment (yes/no) | 127/340 | 319/101 |
| National Psoriasis Foundation psoriasis score (<7.5/7.5-12.5/>12.5) | 124/132/129 | — |
| Inverse Psoriasis (yes/no) | 85/382 | — |
| Guttate Psoriasis (yes/no) | 36/431 | — |
| Plaque Psoriasis | | 432 |
| Nail involvment (yes/no) | 277/190 | — |
| Scalp only (yes/no) | 46/421 | — |
| PASI score (<10/10-50/>50) | — | 364/103/4 |

[1]For pooling, seven subphenotypes were examined in the discovery sample set and six subphenotypes were examined in the replication sample set (see below for details). Each patient was assessed for each of the relevant subphenotypes and an aliquot of standardized DNA was added to the appropriate pool. If no information was available for a particular subphenotype of a patient, that patient's DNA was not included in that subphenotype pool.
[2]For the discovery sample set there were a total of 40 pools - 20 case pools and 20 control pools (due to DNA availability at the time the pools were constructed, only 466 cases were included in the pooled case DNAs). The seven subphenotypes studied and the composition of the case pools are as follows: A) Age of psoriasis onset: Pool 1 - age of onset <18 years, 142 patients; Pool 2 - age of onset between 18 and 32 years of age, 168 patients; Pool 3 - age of onset >32 years, 156 patients; B) Family history of psoriasis (yes/no): Pool 4 - yes, 145 patients; Pool 5 - yes, 146 additional patients; Pool 6 - no, 175 patients; C) Psoriasis worsens after infection (yes/no): Pool 7 - yes, 72 patients; Pool 8 - no, 187 patients; Pool 9 - no, 188 additional patients; D) Psoriatic arthritis (yes/no): Pool 10 - yes, 124 patients; Pool 11 - no psoriatic arthritis 10 or more years after psoriasis diagnosis, 120 patients; Pool 12 - no psoriatic arthritis 10 or more years after psoriasis diagnosis, 119 additional patients; E) Plaque thickness without therapy: Pool 13 - thick plaques, 126 patients; Pool 14 - thin plaques, 110 patients; F) Percent body surface covered when disease is at its worse: Pool 15 - >13%, 185 patients; Pool 16 - <13%, 141 patients; Pool 17 - <13%, 140 additional patients; G) Disease severity with treatment as determined by the National Psoriasis FoundationPsoriasis Score (NSF PS): Pool 18 - NPF PS < 7.5, 123 patients; Pool 19 - NPF PS of 7.5-11.2, 132 patients; Pool 20 - NPF PS of >11.2, 129 patients. The controls in this sample set were not individually matched to the cases; consequently, all 500 were distributed into the same number of pools for each case subphenotype attempting to approximate the gender ratio found in each case pool. For example, the 500 controls were split into three pools for comparison with the subphenotype age of onset such that the percentage of females in each of the three control pools was similar to that of its "matched" case pool.
[3]For replication sample set 1 there were a total of 42 pools - 21 case pools and 21 control pools. The six subphenotypes studied and the composition of the case pools are as follows: A) Age of onset: Pool 1 - <18 years, 125 patients; Pool 2 - between 18 and 32 years of age, 171 patients; Pool 3 - >32 years, 202 patients; B) Family history (yes/no): Pool 4 - yes, 232 patients; Pool 5 - no, 133 patients; Pool 6 - no, 132 additional patients; C) Psoriasis worsensafter infection (yes/no): Pool 7 - yes, 111 patients; Pool 8 - no, 192 patients; Pool 9 - no, 192 additional patients; D) Psoriatic arthritis (yes/no): Pool 10 - yes, 98 patients, Pool 11 - a replicate of pool 10, Pool 12 - no psoriatic arthritis 10 or more years after psoriasis diagnosis, 143 patients; E) Thick plaque after therapy (yes/no): Pool 13 - yes, 160 patients; Pool 14 - yes, 159 additional patients; Pool 15 - no, 101 patients; F) Plaque form of psoriasis (yes/no):Pool 16 - yes, 216 patients; Pool 17 - yes, 216 additional patients; G) Cases: Pool 18 - 249 cases, Pool 19 - the remaining 249 cases, Pool 20 - a replicate of pool 18, Pool 21 - a replicate of pool 19 (these replicate case-only pools help minimize allele frequency measurement error). In this sample set the controls were individually matched to the patients; consequently, each control was placed into pools according to the pooling strategy of its matched case.

TABLE 9

Allele frequencies and allele-based association of the 32 most significant markers with psoriasis using pooled DNAs[a]

| | | | Discovery Sample Set | | | | Replication Sample Set 1 | | | |
|---|---|---|---|---|---|---|---|---|---|---|
| dbSNP ID | Chromosome | Alleles[b] | Cases (n = 466) | Controls (n = 500) | OR | Allelic P-value | Cases (n = 498) | Controls (n = 498) | OR | Allelic P-value |
| ss52085987 | 6 | T/G | 0.151 | 0.064 | 2.61 | 3.13E−10 | 0.125 | 0.050 | 2.71 | 2.86E−09 |
| rs361525 | 6 | A/G | 0.123 | 0.046 | 2.94 | 5.25E−10 | 0.115 | 0.060 | 2.04 | 1.51E−05 |
| rs2280801 | 6 | A/G | 0.148 | 0.066 | 2.45 | 4.20E−09 | 0.139 | 0.060 | 2.54 | 2.11E−09 |
| rs130076 | 6 | T/C | 0.342 | 0.227 | 1.75 | 2.27E−08 | 0.364 | 0.237 | 1.85 | 4.84E−10 |

TABLE 9-continued

Allele frequencies and allele-based association of the 32 most significant markers with psoriasis using pooled DNAs[a]

| | | | Discovery Sample Set | | | | Replication Sample Set 1 | | | |
|---|---|---|---|---|---|---|---|---|---|---|
| dbSNP ID | Chromosome | Alleles[b] | Cases (n = 466) | Controls (n = 500) | OR | Allelic P-value | Cases (n = 498) | Controls (n = 498) | OR | Allelic P-value |
| rs130065 | 6 | T/C | 0.338 | 0.230 | 1.72 | 1.28E−07 | 0.379 | 0.259 | 1.75 | 9.75E−09 |
| rs8192591 | 6 | A/G | 0.106 | 0.044 | 2.55 | 1.96E−07 | 0.095 | 0.045 | 2.21 | 1.46E−05 |
| ss52085992 | 6 | T/C | 0.195 | 0.112 | 1.92 | 3.45E−07 | 0.205 | 0.117 | 1.96 | 7.03E−08 |
| rs1398828 | 4 | G/A | 0.367 | 0.257 | 1.67 | 5.09E−07 | 0.263 | 0.254 | 1.04 | 0.682 |
| rs3734843 | 6 | A/G | 0.140 | 0.071 | 2.13 | 6.51E−07 | 0.143 | 0.065 | 2.42 | 7.08E−09 |
| rs2853941 | 6 | A/G | 0.502 | 0.394 | 1.54 | 1.85E−06 | 0.493 | 0.371 | 1.65 | 4.29E−08 |
| rs1265076 | 6 | T/C | 0.440 | 0.337 | 1.54 | 2.88E−06 | 0.496 | 0.348 | 1.85 | 2.38E−11 |
| ss48430373 | 6 | G/T | 0.248 | 0.163 | 1.69 | 3.19E−06 | 0.267 | 0.167 | 1.82 | 6.66E−08 |
| ss52085989 | 6 | T/C | 0.080 | 0.033 | 2.58 | 4.23E−06 | 0.091 | 0.037 | 2.57 | 9.16E−07 |
| rs1063478 | 6 | T/C | 0.150 | 0.084 | 1.93 | 4.78E−06 | 0.159 | 0.102 | 1.65 | 2.44E−04 |
| rs1051794 | 6 | A/G | 0.332 | 0.239 | 1.59 | 5.72E−06 | 0.338 | 0.265 | 1.42 | 4.37E−04 |
| rs2114437 | 6 | C/G | 0.101 | 0.047 | 2.25 | 6.34E−06 | 0.099 | 0.047 | 2.24 | 9.63E−06 |
| rs1371458 | 10 | G/C | 0.096 | 0.168 | 0.53 | 1.03E−05 | 0.107 | 0.126 | 0.83 | 0.209 |
| rs2273137 | 20 | C/T | 0.065 | 0.125 | 0.48 | 1.32E−05 | 0.073 | 0.086 | 0.84 | 0.321 |
| rs432925 | 16 | C/G | 0.382 | 0.286 | 1.54 | 1.52E−05 | 0.266 | 0.284 | 1.09 | 0.393 |
| rs17107076 | 14 | T/C | 0.024 | 0.002 | 14.84 | 2.03E−05 | 0.001 | 0.001 | 1.07 | 1.000 |
| rs2523733 | 6 | T/G | 0.180 | 0.112 | 1.75 | 2.14E−05 | 0.235 | 0.135 | 1.96 | 9.29E−09 |
| rs1576 | 6 | G/C | 0.393 | 0.302 | 1.49 | 2.59E−05 | 0.438 | 0.296 | 1.86 | 5.04E−11 |
| rs916920 | 6 | G/A | 0.240 | 0.163 | 1.61 | 2.76E−05 | 0.288 | 0.178 | 1.87 | 6.73E−09 |
| rs15574 | 6 | T/C | 0.367 | 0.278 | 1.51 | 2.87E−05 | 0.367 | 0.334 | 1.16 | 0.121 |
| rs1535287 | 6 | T/C | 0.370 | 0.469 | 0.67 | 2.97E−05 | 0.399 | 0.396 | 1.01 | 0.891 |
| ss48423448 | 6 | C/T | 0.047 | 0.015 | 3.23 | 3.24E−05 | 0.064 | 0.024 | 2.84 | 8.15E−06 |
| rs707936 | 6 | T/C | 0.085 | 0.040 | 2.22 | 4.21E−05 | 0.081 | 0.069 | 1.20 | 0.306771 |
| rs1046276 | 16 | T/C | 0.445 | 0.354 | 1.47 | 4.50E−05 | 0.409 | 0.392 | 1.08 | 0.464 |
| ss52085988 | 6 | T/C | 0.119 | 0.066 | 1.92 | 4.78E−05 | 0.128 | 0.065 | 2.11 | 2.22E−06 |
| rs3212227 | 5 | C/A | 0.148 | 0.219 | 0.62 | 5.03E−05 | 0.154 | 0.256 | 0.53 | 1.88E−08 |
| rs3096696 | 6 | T/G | 0.294 | 0.214 | 1.54 | 5.24E−05 | 0.301 | 0.217 | 1.55 | 2.13E−05 |
| ss52085991 | 6 | G/A | 0.229 | 0.310 | 0.66 | 5.43E−05 | 0.235 | 0.270 | 0.83 | 0.079 |

[a]Alleles are listed according to their significance (P-values) in the discovery samples. Data are reported for the minor allele.
[b]The two alleles for the indicated SNP (minor allele/major allele).

TABLE 10

Table 10. Case-control analysis of rs3212227[a]

| | | Allelic Association | | | | Genotypic |
|---|---|---|---|---|---|---|
| | Allele | Case Count (Freq) | Control Count (Freq) | Risk Allele OR, 95% CI[b] | P-value[c] | Association Genotype |
| Discovery | C | 133 (0.143) | 192 (0.209) | | | CC |
| | A | 799 (0.857) | 726 (0.791) | 1.59 (1.25-2.03) | 1.89E−04 | CA |
| | | | | | | AA |
| Replication 1 | C | 135 (0.137) | 219 (0.223) | | | CC |
| | A | 849 (0.863) | 763 (0.777) | 1.81 (1.42-2.28) | 7.59E−07 | CA |
| | | | | | | AA |
| Combined | | | | 1.70 (1.43-2.01) | 3.39E−09 | |

| | Genotypic Association | | | | | |
|---|---|---|---|---|---|---|
| | Case Count (Freq) | Control Count (Freq) | P-value[d] | | OR (95% CI)[b] | γ[e] |
| Discovery | 10 (0.021) | 22 (0.047) | | | | |
| | 113 (0.242) | 148 (0.322) | | CA v CC | 1.68 (0.76-3.69) | 1.67 |
| | 343 (0.736) | 289 (0.630) | | AA v CC | 2.61 (1.22-5.60) | 2.57 |
| | | | 0.001 | AA + CA v CC | 2.29 (1.07-4.90) | 2.27 |
| Replication 1 | 12 (0.024) | 24 (0.049) | | | | |
| | 111 (0.226) | 171 (0.348) | | CA v CC | 1.30 (0.62-2.70) | 1.29 |
| | 369 (0.750) | 296 (0.603) | | AA v CC | 2.49 (1.23-5.07) | 2.45 |
| | | | 4.17E−06 | AA + CA v CC | 2.06 (1.02-4.16) | 2.03 |

TABLE 10-continued

Table 10. Case-control analysis of rs3212227[a]

| | | | |
|---|---|---|---|
| Combined | 8.68E−08 | CA v CC | 1.47 (0.86-2.50) |
| | | AA v CC | 2.55 (1.52-4.28) |
| | | AA + CA v CC | 2.16 (1.29-3.63) |

[a]Individual genotyping was performed on 467 cases and 460 controls from the discovery sample set.
[b]Odds ratios for the discovery and replication sample sets were determined for the common risk allele using standard methods. For the combined analysis, the method of Mantel-Haenszel was used.
[c]Allelic P-values for the discovery and replication sample sets were calculated using Fisher's exact test. Allelic combined P-values were determined using Fisher's combined test.
[d]Genotypic P-values were calculated using the Williams-corrected G-test. Genotypic combined P-values were determined using Fisher's combined test.
[e]Relative risk (γ) estimates for the indicated genotypes were calculated using a Bayesian approach as described in the methods.

TABLE 11

Table 11. Minor allele frequencies and allele-based association of IL12B-associated SNPs with psoriasis[a]

| | | | | Discovery Sample Set[b] | | | | Replication Sample Set 1 |
|---|---|---|---|---|---|---|---|---|
| | | | | Frequency in | | | | Frequency in |
| dbSNP ID | Gene | Type | Position & Alleles[c] | Cases (n = 467) | Controls (n = 460) | OR | Allelic P-value[d] | Cases (n = 498) |
| rs929779 | EBF | intron | T158420776G | 0.465 | 0.452 | 1.05 | 0.608 | 0.488 |
| rs1422668 | EBF | intron | G158438712A | 0.310 | 0.324 | 0.94 | 0.549 | 0.343 |
| rs6898290 | EBF | intron | C158446124T | 0.415 | 0.413 | 1.01 | 0.925 | 0.453 |
| rs2161357 | | intergenic | C158469697T | 0.193 | 0.215 | 0.88 | 0.273 | 0.218 |
| rs6897374 | | intergenic | A158473778C | 0.090 | 0.074 | 1.24 | 0.236 | 0.084 |
| rs6896438 | | intergenic | C158480454G | 0.390 | 0.400 | 0.96 | 0.669 | 0.398 |
| rs270661 | | intergenic | A158492732G | 0.197 | 0.200 | 0.98 | 0.907 | 0.233 |
| rs270654 | | intergenic | G158497687A | 0.109 | 0.103 | 1.07 | 0.651 | 0.134 |
| rs6556398 | | intergenic | A158505815C | 0.321 | 0.304 | 1.08 | 0.452 | 0.297 |
| rs717925 | | intergenic | C158513109G | 0.014 | 0.015 | 0.91 | 0.848 | 0.010 |
| rs10035989 | FLJ31951 | UTR | C158517569T | 0.198 | 0.190 | 1.06 | 0.638 | 0.194 |
| rs2043270 | FLJ31951 | intron | G158530559A | 0.088 | 0.075 | 1.18 | 0.350 | 0.081 |
| rs1897565 | FLJ31951 | intron | C158550843T | 0.212 | 0.273 | 0.71 | 0.002 | 0.243 |
| rs7721001 | | intergenic | T158583392C | 0.418 | 0.466 | 0.82 | 0.039 | 0.477 |
| rs11744690 | | intergenic | C158619731T | 0.345 | 0.329 | 1.07 | 0.489 | 0.323 |
| rs1368437 | MGC10067 | intron | G158639557C | 0.118 | 0.094 | 1.29 | 0.097 | 0.130 |
| rs3212227 | IL12B | UTR | C158675528A | 0.143 | 0.209 | 0.63 | 1.89E-04 | 0.137 |
| rs3213119 | IL12B | F298V | T158676366G | 0.031 | 0.027 | 1.15 | 0.680 | 0.030 |
| rs3213096 | IL12B | I33V | A158682907G | 0.000 | 0.003 | NC | 0.122 | 0.002 |
| rs3212220 | IL12B | intron | T158686773G | 0.144 | 0.207 | 0.64 | 3.81E-04 | 0.141 |
| rs1433048 | IL12B | intron | G158688423A | 0.213 | 0.185 | 1.19 | 0.146 | 0.212 |
| ss52085993[g] | IL12B | promoter | GC158692778TTAGAG | 0.453 | 0.498 | 0.83 | 0.056 | 0.462 |
| rs7709212[h] | | intergenic | C158696753T | 0.272 | 0.333 | 0.75 | 0.005 | 0.267 |
| rs953861[h] | | intergenic | G158705160A | 0.190 | 0.169 | 1.15 | 0.250 | 0.220 |
| rs6869411[h] | | intergenic | C158714182T | 0.390 | 0.388 | 1.01 | 0.962 | 0.358 |
| rs1833754 | | intergenic | G158751505A | 0.042 | 0.052 | 0.79 | 0.323 | 0.047 |
| rs6887695 | | intergenic | C158755223G | 0.254 | 0.319 | 0.73 | 0.002 | 0.242 |
| rs918520 | | intergenic | C158758888G | 0.253 | 0.203 | 1.33 | 0.011 | 0.246 |
| rs4921226 | | intergenic | A158763397G | 0.317 | 0.340 | 0.90 | 0.320 | 0.365 |
| rs1422878 | | intergenic | A158771795G | 0.355 | 0.369 | 0.94 | 0.562 | 0.296 |
| rs4921496 | | intergenic | T158780649C | 0.274 | 0.249 | 1.14 | 0.245 | 0.291 |

| | Replication Sample Set 1 | | | Replication Sample Set 2 | | | | Combined Analysis | |
|---|---|---|---|---|---|---|---|---|---|
| | Frequency in | | | Frequency in | | | | | |
| | Controls | | Allelic | Cases | Controls | | Allelic | | |
| dbSNP ID | (n = 498) | OR | P-value[d] | (n = 481) | (n = 424) | OR | P-value[d] | OR$_{common}$ (95% CI)[e] | P$_{comb}$[f] |
| rs929779 | 0.487 | 1.00 | 1.000 | | | | | | |
| rs1422668 | 0.337 | 1.03 | 0.813 | | | | | | |
| rs6898290 | 0.441 | 1.05 | 0.619 | | | | | | |
| rs2161357 | 0.198 | 1.13 | 0.293 | | | | | | |
| rs6897374 | 0.103 | 0.80 | 0.165 | | | | | | |
| rs6896438 | 0.391 | 1.03 | 0.748 | | | | | | |
| rs270661 | 0.183 | 1.36 | 0.007 | | | | | | |
| rs270654 | 0.110 | 1.27 | 0.100 | | | | | | |
| rs6556398 | 0.320 | 0.90 | 0.285 | | | | | | |
| rs717925 | 0.028 | 0.35 | 0.005 | | | | | | |
| rs10035989 | 0.185 | 1.06 | 0.607 | | | | | | |

TABLE 11-continued

Table 11. Minor allele frequencies and allele-based association of IL12B-associated SNPs with psoriasis[a]

| | | | | | | | | |
|---|---|---|---|---|---|---|---|---|
| rs2043270 | 0.071 | 1.15 | 0.448 | | | | | |
| rs1897565 | 0.280 | 0.83 | 0.066 | | | | | |
| rs7721001 | 0.470 | 1.03 | 0.787 | | | | | |
| rs11744690 | 0.307 | 1.08 | 0.440 | | | | | |
| rs1368437 | 0.101 | 1.33 | 0.049 | | | | | |
| rs3212227 | 0.223 | 0.55 | 7.59E−07 | 0.167 | 0.212 | 0.74 | 0.014 | 0.64 (0.56-0.73) | 7.85E−10 |
| rs3213119 | 0.039 | 0.77 | 0.327 | | | | | |
| rs3213096 | 0.000 | NC | 0.248 | | | | | |
| rs3212220 | 0.225 | 0.56 | 1.37E−06 | | | | | |
| rs1433048 | 0.190 | 1.15 | 0.239 | | | | | |
| ss52085993[g] | 0.511 | 0.82 | 0.031 | | | | | |
| rs7709212[h] | 0.351 | 0.68 | 6.65E−05 | | | | | |
| rs953861[h] | 0.179 | 1.30 | 0.025 | | | | | |
| rs6869411[h] | 0.339 | 1.09 | 0.421 | | | | | |
| rs1833754 | 0.060 | 0.78 | 0.198 | | | | | |
| rs6887695 | 0.333 | 0.64 | 9.77E−06 | 0.251 | 0.308 | 0.75 | 0.007 | 0.70 (0.63-0.79) | 4.08E−08 |
| rs918520 | 0.216 | 1.18 | 0.123 | | | | | |
| rs4921226 | 0.328 | 1.18 | 0.094 | | | | | |
| rs1422878 | 0.376 | 0.70 | 1.73E−04 | | | | | |
| rs4921496 | 0.265 | 1.14 | 0.193 | | | | | |

[a]The data used to calculate these frequencies are from individual genotyping. Results are reported for the minor allele.
[b]Individual genotyping was performed on 467 cases and 460 controls from the discovery sample set.
[c]Positions are according to genomic contig NT_023133. The minor allele is listed first, followed by the position in genome build 35.1 and then the major allele.
[d]P-values were calculated using Fisher's exact test.
[e]Calculated using a Mantel-Haenszel common odds ratio.
[f]Calculated using Fisher's combined test.
[g]Putative promoter polymorphism.[43]
[h]SNP is located within AK097548, a gene model with one mRNA as supporting evidence.

TABLE 12

Table 12. Two marker haplotypes for the IL12B region[a]

| | | | Discovery Sample Set Global P = 0.001 | | | | Replication Sample Set 1 Global P = 5.13E−08 | |
|---|---|---|---|---|---|---|---|---|
| Haplotype | rs3212227 | rs6887695 | Case (n = 467) | Control n = 460 | OR | P-value | Case (n = 498) | Control (n = 498) |
| 1 | A | G | 667 (0.714) | 587 (0.638) | 1.42 | 3.27E−04 | 716 (0.719) | 631 (0.634) |
| 2 | A | C | 134 (0.144) | 141 (0.153) | 0.93 | 0.454 | 144 (0.145) | 143 (0.142) |
| 3 | C | C | 103 (0.110) | 152 (0.166) | 0.63 | 5.80E−04 | 96 (0.096) | 188 (0.190) |
| 4 | C | G | 30 (0.032) | 40 (0.043) | 0.73 | 0.145 | 40 (0.040) | 34 (0.035) |

| | Replication Sample Set 1 Global P = 5.13E−08 | | Replication Sample Set 2 Global P = 0.029 | | | | Combined Analysis Global $P_{comb}$ = 5.94E−10[b] | |
|---|---|---|---|---|---|---|---|---|
| Haplotype | OR | P-value | Case (n = 481) | Control (n = 424) | OR | P-value | $OR_{common}$ (95% CI)[c] | $P_{comb}$[b] |
| 1 | 1.48 | 1.35E−05 | 678 (0.705) | 548 (0.646) | 1.31 | 6.00E−03 | 1.40 (1.25-1.57) | 8.11E−09 |
| 2 | 1.01 | 0.874 | 124 (0.129) | 120 (0.142) | 0.90 | 0.345 | 0.95 (0.82-1.10) | 0.680 |
| 3 | 0.46 | 2.56E−09 | 117 (0.122) | 140 (0.165) | 0.70 | 7.00E−03 | 0.58 (0.50-0.68) | 5.65E−12 |
| 4 | 1.18 | 0.731 | 43 (0.045) | 40 (0.047) | 0.95 | 0.693 | 0.94 (0.72-1.24) | 0.516 |

[a] A pseudo-Gibbs sampling algorithm from the program SNP Analyzer was used to estimate haplotype frequencies from unphased data treating cases and controls separately. The Haplo.Stats package was used to test for association between haplotypes and disease status.
[b] Calculated using Fisher's combined test.
[c] Calculated using a Mantel-Haenszel common odds ratio.

TABLE 13

Three marker IL12B haplotypes including the putative promotor polymorphism, ss52085993[a]

| | | | | Discovery Global P = 0.007 | | | Replication Global P = 2.4E−06 | | |
|---|---|---|---|---|---|---|---|---|---|
| Haplotype | rs3212227 | ss52085993[b] | rs6887695 | Case | Control | P-value | Case | Control | P-value |
| 1 | A | T | G | 495 (0.530) | 435 (0.473) | 0.015 | 513 (0.515) | 464 (0.466) | 0.026 |
| 2 | A | C | G | 172 (0.184) | 151 (0.164) | 0.237 | 202 (0.203) | 168 (0.169) | 0.029 |
| 3 | C | C | C | 103 (0.110) | 152 (0.165) | 0.001 | 95 (0.095) | 187 (0.188) | 3.18E−09 |
| 4 | A | C | C | 125 (0.134) | 128 (0.139) | 0.671 | 135 (0.136) | 130 (0.131) | 0.851 |

TABLE 13-continued

Three marker IL12B haplotypes including the putative promotor polymorphism, ss52085993[a]

| | | | | Discovery Global P = 0.007 | | | Replication Global P = 2.4E-06 | | |
|---|---|---|---|---|---|---|---|---|---|
| Haplotype | rs3212227 | ss52085993[b] | rs6887695 | Case | Control | P-value | Case | Control | P-value |
| 5 | C | C | G | 25 (0.027) | 30 (0.033) | 0.532 | 31 (0.031) | 26 (0.026) | 0.800 |
| 6 | C | T | G | 9 (0.005) | 11 (0.012) | 0.068 | 10 (0.010) | 8 (0.008) | 0.587 |
| 7 | A | T | C | 9 (0.010) | 13 (0.014) | 0.330 | 10 (0.010) | 13 (0.013) | 0.454 |

[a] A pseudo-Gibbs sampling algorithm from the program SNPAnalyzer was used to estimate haplotype frequencies from unphased data treating cases and controls separately. The Haplo.Stats package was used to test for association between haplotypes and disease status.
[b] C indicates the GC allele; T indicates the TTAGAG allele.

TABLE 14

Table 14. Allele frequencies and allele-based association of markers in IL12B-related genes[a]

| | | | | | Discovery Sample Set | | | | Replication Sample Set 1 |
|---|---|---|---|---|---|---|---|---|---|
| | | | | | Frequency in | | | | Frequency in |
| Locus | dbSNP ID | Type | Chromosome | Position[b] | Cases (n = 467) | Controls (n = 460) | OR | Allelic P-value[c] | Cases (n = 498) |
| IL23R | rs1884444 | H3Q | 1 | G67345833T | 0.451 | 0.476 | 0.90 | 0.284 | |
| IL23R | rs7530511 | L310P | 1 | T67397408C | 0.103 | 0.146 | 0.67 | 0.006 | 0.100 |
| IL23R | rs11209026 | Q381R | 1 | A67417979G | 0.044 | 0.060 | 0.73 | 0.142 | 0.051 |
| IL12RB2 | rs1109918 | 3UTR | 1 | C67574503T | 0.026 | 0.024 | 1.08 | 0.882 | |
| IL12A | rs583911 | intron | 3 | G161193092A | 0.421 | 0.449 | 0.89 | 0.241 | |
| IL12A | rs2227314 | intron | 3 | T161194756C | 0.422 | 0.448 | 0.89 | 0.259 | |
| IL12A | rs2243131 | intron | 3 | C161194760A | 0.161 | 0.139 | 1.18 | 0.216 | |
| IL12A | rs2243149 | intergenic | 3 | T161198414C | 0.419 | 0.413 | 1.02 | 0.814 | |
| IL12A | rs2243154 | intergenic | 3 | A161198944G | 0.086 | 0.080 | 1.07 | 0.737 | |
| IL12A | rs6771983 | intergenic | 3 | T161221155C | 0.007 | 0.004 | 1.73 | 0.548 | |
| IL12A | rs2914119 | intergenic | 3 | T161227140C | 0.160 | 0.196 | 0.78 | 0.045 | 0.191 |
| IL23A | rs2371494 | intergenic | 12 | A55014267G | 0.058 | 0.074 | 0.77 | 0.161 | |
| IL23A | rs11171806 | S106S | 12 | A55019798G | 0.054 | 0.073 | 0.72 | 0.104 | |
| IL12RB1 | rs401502 | G378R | 19 | G18041413C | 0.300 | 0.313 | 0.94 | 0.579 | |
| IL12RB1 | rs375947 | T365M | 19 | G18041451A | 0.301 | 0.313 | 0.95 | 0.614 | |
| IL12RB1 | rs11575926 | H156R | 19 | A18049408G | 0.176 | 0.174 | 1.01 | 0.951 | |
| IL12RB1 | rs393548 | intergenic | 19 | A18058744T | 0.206 | 0.210 | 0.97 | 0.819 | |

| | Replication Sample Set 1 | | | Replication Sample Set 2 | | | | Combined Analysis | |
|---|---|---|---|---|---|---|---|---|---|
| | Frequency in | | | Frequency in | | | | | |
| Locus | Controls (n = 498) | OR | Allelic P-value[c] | Cases (n = 4) | Controls (n = 498) | OR | Allelic P-value[c] | OR$_{common}$ (95% CI)[d] | P$_{comb}$[e] |
| IL23R | | | | | | | | | |
| IL23R | 0.114 | 0.87 | 0.347 | 0.108 | 0.130 | 0.81 | 0.166 | 0.78 (0.66-0.91) | 0.014 |
| IL23R | 0.077 | 0.65 | 0.004 | 0.035 | 0.066 | 0.52 | 0.003 | 0.63 (0.50-0.79) | 1.89E-04 |
| IL12RB2 | | | | | | | | | |
| IL12A | | | | | | | | | |
| IL12A | | | | | | | | | |
| IL12A | | | | | | | | | |
| IL12A | | | | | | | | | |
| IL12A | | | | | | | | | |
| IL12A | | | | | | | | | |
| IL12A | 0.190 | 1.01 | 0.955 | | | | | | |
| IL23A | | | | | | | | | |
| IL23A | | | | | | | | | |
| IL12RB1 | | | | | | | | | |
| IL12RB1 | | | | | | | | | |
| IL12RB1 | | | | | | | | | |
| IL12RB1 | | | | | | | | | |

[a] The data used to calculate these frequencies are from individual genotyping. Results are reported for the minor allele.
[b] The minor allele is listed first, followed by the position in genome build 35.1 and then the major allele.
[c] P-values were calculated using Fisher's exact test.
[d] Calculated using a Mantel-Haenszel common odds ratio.
[e] Calculated using Fisher's combined test.

TABLE 15

Table 15. Two marker haplotypes for the IL23R gene[a]

| Haplotype | rs7530511 | rs11209026 | Discovery Sample Set Global P = 0.004 ||||  Replication Sample Set 1 Global P = 0.002 ||||
|---|---|---|---|---|---|---|---|---|---|---|
| | | | Case (N = 467) | Control (n = 460) | OR | P-value | Case (n = 498) | Control (n = 498) | OR | P-value |
| 1 | C | G | 796 (0.852) | 730 (0.793) | 1.50 | 9.48E−04 | 840 (0.843) | 794 (0.797) | 1.37 | 0.006 |
| 2 | T | G | 96 (0.103) | 135 (0.147) | 0.67 | 0.005 | 98 (0.098) | 113 (0.113) | 0.85 | 0.249 |
| 3 | C | A | 42 (0.045) | 55 (0.060) | 0.74 | 0.134 | 56 (0.056) | 89 (0.089) | 0.61 | 0.004 |
| 4 | T | A | 0 | 0 | | | 2 (0.002) | 0 | | |

| Haplotype | Replication Sample Set 2 Global P = 0.003 |||| Combined Analysis Global $P_{comb}$ = 4.14E−06[b] ||
|---|---|---|---|---|---|---|
| | Case (n = 481) | Control (n = 424) | OR | P-value | $OR_{common}$ (95% CI)[c] | $P_{comb}$[b] |
| 1 | 824 (0.857) | 682 (0.804) | 1.45 | 0.003 | 1.44 (1.25-1.65) | 3.13E−06 |
| 2 | 104 (0.108) | 110 (0.130) | 0.81 | 0.003 | 0.77 (0.65-0.91) | 3.22E−04 |
| 3 | 34 (0.035) | 56 (0.066) | 0.52 | 0.153 | 0.62 (0.49-0.77) | 0.005 |
| 4 | 0 | 0 | | | | |

[a] A pseudo-Gibbs sampling algorithm from the program SNPAnalyzer was used to estimate haplotype frequencies from unphased genotyping data treating cases and controls separately. The Haplo.Stats package was used to test for association between haplotypes and disease status.
[b] Calculated using Fisher's combined test.
[c] Calculated using a Mantel-Haenszel common odds ratio.

TABLE 16

Table 16. Diplotype analysis for the IL12B SNPs rs3212227 and rs6887695

| Diplotype[c] | Discovery Sample Set Global P = 0.033[a] |||| Replication Sample Set 1 Global P = 3.21E−07[a] ||||
|---|---|---|---|---|---|---|---|---|
| | No. of Cases (%) | No. of Controls (%) | OR | P-value[d] | No. of Cases (%) | No. of Controls (%) | OR | P-value[d] |
| A-G/A-G | 238 (0.510) | 186 (0.403) | 1.53 | 1.54E−03 | 252 (0.506) | 190 (0.382) | 1.66 | 9.81E−05 |
| A-G/C-C | 75 (0.161) | 96 (0.209) | 0.73 | 0.063 | 73 (0.147) | 121 (0.243) | 0.54 | 1.60E−04 |
| A-G/A-C | 91 (0.195) | 90 (0.196) | 0.99 | 1 | 107 (0.215) | 104 (0.209) | 1.04 | 0.877 |
| A-G/C-G | 25 (0.054) | 29 (0.063) | 0.84 | 0.576 | 32 (0.064) | 26 (0.052) | 1.25 | 0.499 |
| C-C/C-C | 6 (0.013) | 13 (0.028) | 0.45 | 0.109 | 4 (0.008) | 16 (0.032) | 0.24 | 0.011 |
| C-C/A-C | 13 (0.028) | 23 (0.050) | 0.54 | 0.090 | 7 (0.014) | 27 (0.054) | 0.25 | 6.70E−04 |
| C-C/C-G | 3 (0.006) | 7 (0.015) | 0.42 | 0.221 | 8 (0.016) | 8 (0.016) | 1.00 | 1 |
| A-C/A-C | 15 (0.032) | 14 (0.031) | 1.06 | 1 | 15 (0.030) | 6 (0.012) | 2.55 | 0.075 |
| A-C/C-G | 0 | 0 | | | 0 | 0 | | |
| C-G/C-G | 1 (0.002) | 2 (0.004) | 0.49 | 0.622 | 0 | 0 | | |

| Diplotype[c] | Replication Sample Set 1 Global P = 0.042[a] |||| Combined Analysis Global P = 1.13E−07[b] ||
|---|---|---|---|---|---|---|
| | No. of Cases (%) | No. of Controls (%) | OR | P-value[d] | $OR_{common}$ (95% CI)[e] | $P_{comb}$[f] |
| A-G/A-G | 232 (0.482) | 171 (0.403) | 1.38 | 0.019 | 1.52 (1.31-1.77) | 6.14E−07 |
| A-G/C-C | 84 (0.175) | 91 (0.215) | 0.77 | 0.130 | 0.67 (0.55-0.81) | 1.39E−04 |
| A-G/A-C | 99 (0.206) | 81 (0.191) | 1.10 | 0.617 | 1.04 (0.87-1.25) | |
| A-G/C-G | 31 (0.064) | 34 (0.080) | 0.79 | 0.370 | 0.94 (0.69-1.27) | |
| C-C/C-C | 5 (0.010) | 8 (0.019) | 0.55 | 0.402 | 0.38 (0.19-0.68) | 0.01 |
| C-C/A-C | 13 (0.027) | 27 (0.064) | 0.41 | 0.009 | 0.39 (0.25-0.59) | 6.51E−05 |
| C-C/C-G | 10 (0.021) | 6 (0.014) | 1.48 | 0.615 | 0.95 (0.50-1.80) | |
| A-C/A-C | 6 (0.012) | 6 (0.014) | 0.88 | 1 | 1.35 (0.81-2.33) | 0.52 |

TABLE 16-continued

Table 16. Diplotype analysis for the IL12B SNPs rs3212227 and rs6887695

| | A-C/C-G | 0 | 0 | |
| | C-G/C-G | 1 (0.002) | 0 | 1 |

[a]Calculated using William's-corrected G-test.
[b]Calculated using Fisher's combined test.
[c]allele 1 rs3212227-allele 1 rs6887695/allele 2 rs3212227-allele 2 rs6887695
[d]P-values calculated using Fisher's exact test.
[e]Calculated using a Mantel-Haenszel common odds ratio.
[f]Calculated for diplotypes with the same effect (risk or protection) in all three sample sets using Fisher's combined test.

TABLE 17

Table 17. Diplotype analysis for the IL23R SNPs rs7530511 and rs11209026

| | Discovery Sample Set Global P = 0.033[a] | | | | Replication Sample Set 1 Global P = 8.47E−06[a] | | | |
|---|---|---|---|---|---|---|---|---|
| Diplotype[c] | No. of Cases (%) | No. of Controls (%) | OR | P-value[d] | No. of Cases (%) | No. of Controls (%) | OR | P-value[d] |
| C-G/C-G | 340 (0.728) | 288 (0.626) | 1.60 | 9.58E−04 | 357 (0.717) | 316 (0.635) | 1.46 | 6.73E−03 |
| C-G/T-G | 84 (0.180) | 112 (0.243) | 0.68 | 0.020 | 81 (0.163) | 90 (0.181) | 0.88 | 0.502 |
| C-G/C-A | 33 (0.071) | 43 (0.093) | 0.74 | 0.232 | 45 (0.090) | 72 (0.145) | 0.59 | 0.010 |
| C-G/T-A | 0 | 0 | | | 0 | 0 | | |
| C-A/C-A | 2 (0.004) | 2 (0.004) | 0.98 | 1 | 1 (0.002) | 5 (0.010) | 0.20 | 0.217 |
| C-A/T-G | 4 (0.009) | 8 (0.017) | 0.47 | 0.260 | 7 (0.014) | 7 (0.014) | 1.00 | 1.000 |
| C-A/T-A | 0 | 0 | | | 2 (0.004) | 0 | | 0.499 |
| T-G/T-G | 4 (0.009) | 7 (0.015) | 0.56 | 0.382 | 5 (0.010) | 8 (0.016) | 0.62 | 0.579 |
| T-G/T-A | 0 | 0 | | | 0 | 0 | | |
| T-A/T-A | 0 | 0 | | | 0 | 0 | | |

| | Replication Sample Set 2 Global P = 0.009[a] | | | | Combined Analysis Global P = 5.45E−07[b] | |
|---|---|---|---|---|---|---|
| Diplotype[c] | No. of Cases (%) | No. of Controls (%) | OR | P-value[d] | OR$_{common}$ (95% CI)[e] | P$_{comb}$[f] |
| C-G/C-G | 350 (0.728) | 279 (0.658) | 1.39 | 0.025 | 1.48 (1.26-1.74) | 2.24E−05 |
| C-G/T-G | 94 (0.195) | 81 (0.191) | 1.03 | 0.933 | 0.85 (0.70-1.02) | |
| C-G/C-A | 30 (0.062) | 43 (0.101) | 0.59 | 0.037 | 0.63 (0.49-0.82) | 0.005 |
| C-G/T-A | 0 | 0 | | | | |
| C-A/C-A | 1 (0.002) | 2 (0.005) | 0.44 | 0.602 | 0.43 (0.08-1.38) | 0.667 |
| C-A/T-G | 2 (0.004) | 9 (0.021) | 0.19 | 0.029 | 0.52 (0.24-1.00) | 0.136 |
| C-A/T-A | 0 | 0 | | | | |
| T-G/T-G | 4 (0.008) | 10 (0.024) | 0.35 | 0.102 | 0.49 (0.23-0.95) | 0.270 |
| T-G/T-A | 0 | 0 | | | | |
| T-A/T-A | 0 | 0 | | | | |

[a]Due to small counts in some of the cells as well as the distribution of these counts, Global P-values were obtained by performing a permutation procedure on the data and generating a log likelihood ratio homogeneity statistic for each permutation. The convergence of the statistic to its limiting distribution was measured by plotting the first two central moments as a function of the number of replicates. When the number of replicates reached a number in which the error of the P-value estimates from a subsequent modeling procedure was negligible (less than 1%), a Gamma distribution was fit using maximum likelihood estimates for the parameters. Integration of the resulting Gamma distribution yielded the global P-values.
[b]Calculated using Fisher's combined test.
[c]Allele 1 rs7530511-allele 1 rs11209026/allele 2 rs7530511-allele 2 rs11209026.
[d]P-values calculated using Fisher's exact test.
[e]Calculated using a Mantel-Haenszel common odds ratio.
[f]Calculated for diplotypes with the same effect (risk or protection) in all three sample sets using Fisher's combined test.

TABLE 18

Table 18. Two-locus diplotypes for IL12B and IL23R[a]

| | Discovery Sample Set Global P = 6.16E−05[a] | | | | Replication Sample Set 1 Global P = 9.72E−04[a] | | | |
|---|---|---|---|---|---|---|---|---|
| Two-locus Diplotype[c] | No. of Cases (%) | No. of Controls (%) | OR | P-value[d] | No. of Cases (%) | No. of Controls (%) | OR | P-value[d] |
| A-G/A-G-C-G/C-G | 175 (0.375) | 110 (0.239) | 1.91 | 9.62E−06 | 174 (0.350) | 121 (0.243) | 1.67 | 2.98E−04 |
| A-G/A-G-C-G/X | 56 (0.120) | 69 (0.150) | 0.77 | 0.211 | 68 (0.137) | 62 (0.125) | 1.11 | 0.638 |
| A-G/A-G-X/X | 7 (0.015) | 7 (0.015) | 0.98 | 1 | 9 (0.018) | 7 (0.014) | 1.29 | 0.802 |
| A-G/X-C-G/C-G | 139 (0.298) | 145 (0.315) | 0.92 | 0.569 | 159 (0.320) | 160 (0.322) | 0.99 | 1 |
| A-G/X-C-G/X | 51 (0.109) | 61 (0.133) | 0.80 | 0.314 | 48 (0.097) | 80 (0.161) | 0.56 | 0.003 |

TABLE 18-continued

Table 18. Two-locus diplotypes for IL12B and IL23R[a]

| | | | | | | | | |
|---|---|---|---|---|---|---|---|---|
| A-G/X-X/X | 1 (0.002) | 9 (0.020) | 0.11 | 0.011 | 5 (0.010) | 10 (0.020) | 0.49 | 0.298 |
| X/X-C-G/C-G | 25 (0.054) | 33 (0.072) | 0.73 | 0.279 | 23 (0.046) | 34 (0.068) | 0.66 | 0.172 |
| X/X-C-G/X | 10 (0.021) | 25 (0.054) | 0.38 | 0.009 | 10 (0.020) | 20 (0.040) | 0.49 | 0.094 |
| X/X-X/X | 3 (0.006) | 1 (0.002) | 2.97 | 0.624 | 1 (0.002) | 3 (0.006) | 0.33 | 0.624 |

| | Replication Sample Set 2 Global P = 0.005[a] | | | | Combined Analysis | |
|---|---|---|---|---|---|---|
| | No. of | No. of | | | Global P = 7.88E−08[b] | |
| Two-locus Diplotype[c] | Cases (%) | Controls (%) | OR | P-value[d] | $OR_{common}$ (95% CI)[e] | $P_{comb}$[f] |
| A-G/A-G-C-G/C-G | 168 (0.349) | 116 (0.274) | 1.43 | 1.50E−02 | 1.66 (1.41-1.95) | 1.33E−08 |
| A-G/A-G-C-G/X | 59 (0.123) | 48 (0.113) | 1.10 | 0.681 | | |
| A-G/A-G-X/X | 4 (0.008) | 7 (0.017) | 0.50 | 0.364 | | |
| A-G/X-C-G/C-G | 154 (0.320) | 138 (0.325) | 0.98 | 0.887 | 0.96 (0.82-1.13) | 0.968 |
| A-G/X-C-G/X | 57 (0.119) | 56 (0.132) | 0.88 | 0.547 | 0.73 (0.58-0.91) | 0.019 |
| A-G/X-X/X | 3 (0.006) | 12 (0.028) | 0.22 | 0.016 | 0.27 (0.11-0.53) | 0.003 |
| X/X-C-G/C-G | 28 (0.058) | 25 (0.059) | 0.99 | 1 | 0.78 (0.57-1.06) | 0.415 |
| X/X-C-G/X | 8 (0.017) | 20 (0.047) | 0.34 | 0.011 | 0.40 (0.25-0.61) | 7.42E−04 |
| X/X-X/X | 0 | 2 (0.005) | 0.00 | 0.219 | | |

[a]Due to small counts in some of the cells as well as the distribution of these counts, Global P-values were obtained by performing a permutation procedure on the data and generating a log likelihood ratio homogeneity statistic for each permutation. The convergence of the statistic to its limiting distribution was measured by plotting the first two central moments as a function of the number of replicates. When the number of replicates reached a number in which the error of the P-value estimates from a subsequent modeling procedure was negligible (less than 1%), a Gamma distribution was fit using maximum likelihood estimates for the parameters. Integration of the resulting Gamma distribution yielded the global P-values.

[b]Calculated using Fisher's combined test.

[c]Allele 1 rs3212227-allele 1 rs6887695/allele 2 rs3212227-allele 2 rs6887695-allele 1 rs7530511-allele 1 rs11209026/allele 2 rs7530511-allele 2 rs11209026. For this analysis the three non-risk haplotypes for each gene were combined and termed X.

[d]P-values calculated using Fisher's exact test.

[e]Calculated using a Mantel-Haenszel common odds ratio.

[f]Calculated for diplotypes with the same effect (risk or protection) in all three sample sets using Fisher's combined test.

TABLE 19

Genotype frequencies for certain significantly associated SNPs across sample sets.

| | | | | | Discovery Sample Set Frequency in | | Replication Sample Set 1 Frequency in | | Replication Sample Set 2 Frequency in | | Combined |
|---|---|---|---|---|---|---|---|---|---|---|---|
| dbSNP ID | Gene | Type | Position | Genotype | Cases (n = 465) | Controls (n = 460) | Cases (n = 494) | Controls (n = 495) | Cases (n = 481) | Controls (n = 424) | Analysis $P_{comb}$ |
| rs7530511 | IL23R | L310P | 97.357 | CC | 0.801 | 0.723 | 0.810 | 0.788 | 0.793 | 0.762 | 0.012572595 |
| | | | | CT | 0.190 | 0.262 | 0.180 | 0.196 | 0.199 | 0.214 | |
| | | | | TT | 0.009 | 0.015 | 0.010 | 0.016 | 0.008 | 0.024 | |
| rs11465804 | IL23R | Intron | 114.496 | TT | 0.924 | 0.889 | 0.887 | 0.846 | 0.929 | 0.871 | 0.000799398 |
| | | | | GT | 0.074 | 0.107 | 0.109 | 0.144 | 0.068 | 0.124 | |
| | | | | GG | 0.002 | 0.004 | 0.004 | 0.010 | 0.002 | 0.005 | |
| rs10889671 | IL23R | Intron | 117.696 | GG | 0.805 | 0.728 | 0.808 | 0.788 | 0.794 | 0.760 | 0.01667346 |
| | | | | AG | 0.186 | 0.259 | 0.180 | 0.198 | 0.195 | 0.214 | |
| | | | | AA | 0.009 | 0.013 | 0.012 | 0.014 | 0.010 | 0.026 | |
| rs11209026 | IL23R | Q381R | 117.928 | GG | 0.918 | 0.885 | 0.888 | 0.832 | 0.932 | 0.873 | 0.000415864 |
| | | | | AG | 0.078 | 0.111 | 0.105 | 0.158 | 0.066 | 0.122 | |
| | | | | AA | 0.004 | 0.004 | 0.006 | 0.010 | 0.002 | 0.005 | |
| rs10889674 | IL23R | Intron | 129.498 | TT | 0.316 | 0.370 | 0.340 | 0.362 | 0.318 | 0.359 | 0.031240837 |
| | | | | GT | 0.492 | 0.475 | 0.454 | 0.467 | 0.476 | 0.472 | |
| | | | | GG | 0.192 | 0.155 | 0.206 | 0.171 | 0.206 | 0.169 | |
| rs1857292 | | 3' of IL23R | 150.292 | AA | 0.795 | 0.736 | 0.800 | 0.762 | 0.805 | 0.768 | 0.019748711 |
| | | | | AT | 0.196 | 0.248 | 0.190 | 0.228 | 0.183 | 0.204 | |
| | | | | TT | 0.009 | 0.015 | 0.010 | 0.010 | 0.012 | 0.028 | |

TABLE 20

Effect sizes for haplotypes at rs7530511-rs11209026-rs10889674.

| | Discovery Sample Set | | | Replication Sample Set 1 | | | Replication Sample Set 2 | | |
|---|---|---|---|---|---|---|---|---|---|
| | Counts | | | Counts | | | Counts | | |
| Haplotype | Cases (n = 465) | Controls (n = 460) | OR | Cases (n = 494) | Controls (n = 495) | OR | Cases (n = 481) | Controls (n = 424) | OR |
| CGG | 404 | 360 | 1.22 | 425 | 403 | 1.11 | 424 | 344 | 1.16 |
| CGT | 385 | 376 | 1.04 | 407 | 390 | 1.09 | 398 | 338 | 1.07 |
| TGT | 95 | 133 | 0.68 | 93 | 113 | 0.81 | 104 | 110 | 0.82 |
| CAT | 40 | 55 | 0.72 | 56 | 88 | 0.62 | 34 | 56 | 0.52 |
| Others | 0 | 2 | N/A | 5 | 0 | N/A | 0 | 0 | N/A |

TABLE 21

| Marker 1 | Marker 2 | Marker 3 | Stratum | AdjustBy | Average Position | Sample Set 1 Global P-value | Sample Set 2 Global P-value | Sample Set 3 Global P-value | Combined P-value |
|---|---|---|---|---|---|---|---|---|---|
| hCV27952715 | hCV1272302 | hCV31222838 | ALL_ALL | NONE | 6.75E+07 | 0.07471465 | 0.2169627 | 0.01968886 | 0.013229 |
| hCV1272302 | hCV31222838 | hCV11283754 | ALL_ALL | NONE | 6.75E+07 | 0.1656072 | 0.2285907 | 0.02535359 | 0.030801 |
| hCV31222838 | hCV11283754 | hCV2989999 | ALL_ALL | NONE | 6.75E+07 | 0.1010597 | 0.3166093 | 0.01700306 | 0.020002 |
| hCV31222826 | hCV31222825 | hCV1272298 | ALL_ALL | NONE | 6.75E+07 | 0.007165026 | 0.02163233 | 0.007676498 | 0.000128 |
| hCV31222825 | hCV1272298 | hCV2720255 | ALL_ALL | NONE | 6.75E+07 | 0.01472221 | 0.005748261 | 0.006339455 | 6.42E−05 |
| hCV1272298 | hCV2720255 | hCV31222811 | ALL_ALL | NONE | 6.75E+07 | 0.1534734 | 0.06696085 | 0.01715119 | 0.008284 |
| hCV8367043 | hCV8367042 | hCV30243123 | ALL_ALL | NONE | 6.75E+07 | 0.139562 | 0.1900267 | 0.007045132 | 0.008677 |

TABLE 22

Therapeutic agents that target IL12 or IL23 which are in active clinical development programs.

| Highest Dev. Status | Company | Drug | Action | Indication | Technology |
|---|---|---|---|---|---|
| Phase 2 Clinical | Abbott, under license from Cambridge Antibody Company | ABT-874 | IL-12 antagonist; Anti-inflammatory; IL-23 antagonist | Inflammation; Multiple sclerosis; Psoriasis; Rheumatoid arthritis; Autoimmune disease; Crohns disease | Monoclonal antibody, fully human; Subcutaneous formulation |
| Phase 2 Clinical | Synta Pharmaceuticals Corp | STA-5326 | IL-12 antagonist; Anti-inflammatory; IL-23 antagonist | Multiple sclerosis; Psoriasis; Rheumatoid arthritis; Autoimmune disease; Crohns disease | Oral formulation |
| Phase 3 Clinical | Centocor Inc | CNTO-1275 | IL-12 antagonist; Immunomodulator; Anti-inflammatory; IL-23 antagonist | Multiple sclerosis; Psoriasis; Crohns disease | Monoclonal antibody, humanized; Subcutaneous formulation |

References for each of the therapeutic agents listed in Table 22:
ABT-874: Sandborn WJ. "How future tumor necrosis factor antagonists and other compounds will meet the remaining challenges in Crohn's disease", Rev Gastroenterol Disord. 2004; 4 Suppl 3: S25-33.
STA-5326: 1) Burakoff et al., "A phase 1/2A trial of STA 5326, an oral interleukin-12/23 inhibitor, in patients with active moderate to severe Crohn's disease", Inflamm Bowel Dis. 2006 Jul; 12(7): 558-65; 2) Borchardt JK. "Focus on small molecule inhibitors for treatment of inflammatory and autoimmune Diseases", Drug News Perspect. 2004 Nov; 17(9): 607-14.
CNTO-1275: Papp KA. "Potential future therapies for psoriasis", Semin Cutan Med Surg. 2005 Mar; 24(1): 58-63.

SEQUENCE LISTING (200 sequences)

SEQ ID NO: 1 - DNA, 2307 bp, Homo sapiens
agatgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacgttcatctgccgcaaaaatgccagcattagcgtgcgggcccaggaccgctactatagctcatcttggagcgaatgggcatctgtgccctgcagttaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccatgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatc

SEQ ID NO: 2 - DNA, 2013 bp, Homo sapiens
cctcattttctcttgccaccactaagtaagaagagccttttgcctcccaccatgattctgaggccttaccagccatgtggaactgttaaagaatttgacaccaattttacatatgtgcaacagtcagaattctacttggagccaaacattaagtacgtatttcaagtgagatgtcaagaaacaggcaaaaggtactggcagccttggagttcaccgttttttcataaaacacctgaaacagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctgg

SEQ ID NO: 3 - DNA, 2812 bp, Homo sapiens
acaagggtggcagcctggctctgaagtggaattatgtgcttcaaacaggttgaaagagggaaacagtcttttcctgcttccagacatgaatcaggtcactattcaatgggatgcagtaatagccctttacatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagagtttagagacagaagaagagcaacagtatctcacctcaagctatattaacatctccactgattcattacaaggtggcaagaagtacttggtttgggtccaagcagcaaacgcactaggcatggaagagtcaaaacaactgcaaattcacctggatgatatagtgataccttctgcagccgtcatttccagggctgagactataaatgctacagtgcccaagaccataatttattgggatagtcaaacaacaattgaaaaggtttcctgtgaaatgagatacaaggctacaacaaaccaaacttggaatgttaaagaatttgacaccaattttacatatgtgcaacagtcagaattctacttggagccaaacattaagtacgtatttcaagtgagatgtcaagaaacaggcaaaaggtactggcagccttggagttcaccgttttttcataaaacacctgaaacagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctgg

SEQ ID NO: 4 - protein, 328 aa, Homo sapiens [sequence omitted]

SEQ ID NO: 5 - protein, 391 aa, Homo sapiens [sequence omitted]

SEQ ID NO: 6 - protein, 629 aa, Homo sapiens [sequence omitted]

SEQ ID NO: 7 - DNA, 201 bp, Homo sapiens
aagacacaacggaatagacccaaaaagataatttctatctgatttgctttaaaacgtttttttaggatcacaatgatatctttgctgtatttgtatagttmgatgctaaatgctcattgaaacaatcagctaatttatgtatagattttccagctctcaagttgccatgggccttcatgctatttaaatatttaagtaatt

SEQ ID NO: 8 - DNA, 201 bp, Homo sapiens
tgtctggaaggcaaaaagatcttaagattcaagagagaggacaagtagttatggctaaggacatgaaattgtcagaatggcaggtggcttcttaacagccmtgtgagaagcagacagatgcaaagaaaatctggaatccctttctcattagcatgaatgaacctgatacacaattatgaccagaaaatatggctccatgaa

SEQ ID NO: 9 - DNA, 201 bp, Homo sapiens
tctgacaacagaggagacattggacttttattgggaatgatcgtctttgctgttatgttgtcaattctttctttgattgggatatttaacagatcattccraactgggattaaaagaaggatcttattgttaataccaaagtggctttatgaagatattcctaatatgaaaaacagcaatgttgtgaaaatgctacaggaa

SEQ ID NO: 10 - DNA, 201 bp, Homo sapiens
gtgcaacagtcagaattctacttggagccaaacattaagtacgtatttcaagtgagatgtcaagaaacaggcaaaaggtactggcagccttggagttcacygttttttcataaaacacctgaaacagttccccaggtcacatcaaaagcattccaacatgacacatggaattctgggctaacagttgcttccatctctaca

SEQ ID NO: 11 - DNA, 201 bp, Homo sapiens; identical to SEQ ID NO: 9

SEQ ID NO: 12 - DNA, 201 bp, Homo sapiens; identical to SEQ ID NO: 10

SEQ ID NO: 13 - DNA, 32003 bp, Homo sapiens
gtatgttagtggtggtgaactaacctcagttcttgcctcctcatgaaacatgaggttttccttgaccccttcagagtcctcctgacaggaatgcctcacttactcagtccacagctctcaacccctcatgggcgggggggcagcacacaggtgagcaggtgcaagagccagagcaaatgcttttgggcaccggcaggaccaaaactctgtgcaggccccacagcagcatctagggtggagtacccatgacccctgcagccccacaggacatatgttacagtgcacttttttagctttgctatccatggttggattaagtgtttaacaactcagtgaaccctctgcctttttgcaagggcagagggtcagtgtgacagcctttagcatcctcacccatggcacctgagatctcgtttggtgtccaggaaaaatcaggttgcatgaacgaattgaagggcggtgaatgtggaggattttattgccagtggaagtggctctccacaggaaggggaggtggaaaggggagggaccgggaaggtattcttcccctgaagtcctgctgtcaagtcatccctctgaagtcaaactgcttctctccagcattcagctgcttcttctctcctccccttctctgctctctgccagtggagcctggggtttttatgggtgcagaatgtgggggcagggtgggccatgggtggtttgggaaacggcaacattggagtgggaaaacaggactacatgttctcactttgggccacagcaccaggcttgagggtgggtctttgccaaaaacccccactcttttctgcctagaatttctctgtctcctgtccctattactcagaagaaagaatttgaccaaagggcttaagacagagtgagagacccaggcaagttttagagcaggagggaaagtttatttaaaaagttttagagcaggaggccagacacagtggctcatgcctgtaatcccagcactttgggaggccgaggcgggtgaatcacttgaggtcaggagttcgagaacatcctggccaacctggtgagaccccatctctactaaaaatacaaaaattagccgggcgtggtagctgtaatctcagctactcaggaggctgaggcacgagaatggcttgaacccaggaggtggaggttgcagtgagccgagattgcgccactgcactccagcctgggagacagagcacgattccatctcaaaaaaaaagttaaaaaaaaagagaaagttttagagcaggaacaaaaggaagtacacttggaagagggagggtgacttgagagattcaagtgtatggtttaacctttgatttggggttgcatatgctggcatgcttctggggggttgcctcccttctcccctgattcttctcttggggtggcctgccagcacttgggaggggccacatacacagtatgtttactgaaattgtacgcatgttcacttgaggcattcttcccttactagttgagtgttcttagaagaagctcatacaccagttaaattcgaccattttccctcctagtgctcatgcttaagcccattcgcccagctcctaagatcttatccggaagctgctaatcaccagcttcaggtgttctatctattgggagactgcctttccctggtaccagctgtgaccaattattattttagagaaacagtttaataaccatctgaccctcacctgatggttgcctgacattcctagtggtggtgggcggggagtggcgggggaaccctcttctgccctgctcatgtctgactagctatctgccgtgacacttccactcttcttttggtaagagcatgtatgtatgaggcaggaggtagaagctacttcccatactcctaggctagaagtatcccttcaaaagcaactgaccatttgggggaagaagccttagttttcattatccacacaattgccctatttctgcacttcactggccgcacaaatcacttggactcatgtaacagacacatgtgactgtatccataataggttcattgcccattgcacacagcaagtcaatacgccgagaggccaggttgcagcagagaaagaggtttaatcgtagggtcaccaaatgaggagacaggaagaaaccttaaatctatctccttgtggcatttggggctagggtttttaagagtttgggagtgggctgatgtgttggagatggttgactggttgaagagtgcatggtgaagtcatgggacagggtgaagctgtattttcaacctgatcccctttctttgtgggggttttcaaactgaaatatggtagaattggggacctgaaaaacaacttaagtgattcttaaacaaaagcgttctgattgtaatgtcagagatcccatctaaaggaacaatagggatacaaatcaattcctacacaatcttatgaccctaatgtcagaaatcctatctacaggaataatgcagatgcaaatggtcaggatctagtgctacatgactttgagcaacaaggaagtgggccaacgtgcaacctaatcaatgcttaattataactatattcctgtccagaacccagcatgcaattcttgtcaaccctgtgagggtggtttcatgactctcaatggcctaccactttccatctagtagggcaaacctgccttgtctatcactttccttgtaataagcccattctccttgtcagggagtggtatacaggtgataagtgagacttcatgaaaaggctatggagcttgtagggcaaattatttgctcctaagagacatcaacaggacaagatagtcttttcttatcccaggtgttatcagtccttagtggattgatgcctggaactgcagagctccttagaaaactaagcccagggcaacctaattgatgcagacgtgaaatctgttcaagtgacctctagcaagtcactgcaagtgactgaatacaaaatagactgttgcaagaaaagagcaacttgcagaacaatatgtatagtatgattccatttatatagccagatagatataaatacatagagaagcattcagaagctctgcaggaatgctggcactggtaacctctggaagccacaggaatcagggcctcaacattgtattctatgtatatttgtattgtttgaagtttttacaatagcatgcatgcatgtattgcttatgtaattttctaagattttaatttttataagtacacatggcttctcctttatttgaaatgtgtactagatgatcaaagcattcttctaggagaaaataagtttttgtggccaaaaaaattctttaagttatttttggtttttagggggttgcctccatgtcacagcttaatcatcagacacattaaccttgcagctcagcacgccctctgtttgtcagcagaccttcctcgcccatagggtaagcaatagaaagcttataggtatcagtttattttgcctgggatcagggtctggattgtgaagtgggacatgttgataaacctcttctccaaaattaggtcaatgggcatttggctcatattaccagaatgctggctggccatgtacagcctgtctccgagagaggctctaatgtggcccccacattagaacaacctgccaatgaccacattagaacctccattgttaaaatgcaggttcctgagccccatcccagatctgaatcacaatctccaagcatcagccccaagaacctgaattttgttgttacatgcagataaagtacgagaaccacttcctccatgggtgaactgaacttaccaaaatagtcagtcccgaggggcagagatggcgtaggtgccagttcttctttctcatcctagatgctcagagtcaaattcttggctcagcaatagacaagtgatttcactgtgggaagacaattcagagccctgttccaggctcctcacattgattctctctgtcttcttccactcctctttgtcatctttgatgtccccttgtgagctacgaaaagactttctgggacacgacaggataaaaaaataaataagtgcaagcagccattcattaaacgtttagccaggatgctgctttaactgcatcccatcatatctcattaatcttcacaccagtcctgagatcaggtactattattaacccgattttacagatgtgaggaactgaggcttaacgaaggtaagtaacttgcaggtgcgggtatccagctctctaactccagagcccatgctcttaaaaccctattacttgtccctggtggaggtgaacactgggggccctttcatataggactagccctcgggctgcaatctgagcggaaaagggaggatgagggcatacttcgaagcttcttttgcataactggcgctggatttttactgagactttacgttacagttttttttttttaattttcaaggtgcttttacgaacacatgaataaaatatttgtgtcattttgaaccttacttgtcttattttatgcatgtatttatttatgggggggcacaaggactcatctgtggtggtgcagccactgtaaataaattagtgaaactacttcacgtcaatttctgttcagtacactttagtgatggatcggaggaaattaatacatgtttacaaaaagcccctcccccagttgttacatatgcctcagagataccagttgtgaaaagtgcaggtgcacttacacacatacgcacacacaccccacaaatggtatcatacgaaaaaacatacctgcaatctgctttgtccacttaattgtatatcttggatacagaacttgtttcactggaaggctaaaaggcaaagtctggggaggcctagaggacacaggggatgggaggaggcgctctgagctggatgtaaggtctccacccacggccagagcacaaggtcggataaccagtgggcctgccggcttggctgcctgggccctcccctgccgagacaaacggctggagggaggaagtgtgcggctgggaagctccgctgctctggcccgggtttcccatttcccccttcccgcgctgagacggcgaggaaagttagcccggaaatctgcgcccgcctaaaacccggcctggtcccagccaccgccccaggaacttcccccaccgcaggggcggaggtcgagagcagggatggagaagtggacctgcgcgggtggactccggggcgcgggtggactccggggcgcggggggactccgaggagcgggtggactgtggggcgcgggtaccgtctcgcagcgacctctgtcggcggctctggggatggcccgcatctgtctgcgtgtacctggtatacgtgcaggtacatgttcctgttcacgtgcagactgggcgggggatgggggggtccacaccggtgtacacctttgcatacctcttagcaacttgaaattccaccacgagagatatctttattccgctattcctgtgcatctgcacggagcccctagggccatagatttgtgtgcaaatgaaatgaggatgtagtctgggtgcccaagggggggtgccttgagtgtggttgtctgtatgcctccctgagggtatttcactttctgctcccatccgcccctatgagcgagtacctatgagcacaggatgtgcacatatttgagtcttattagtggtacacgcagttttatcatctccccaggtctgtgtctgtatgaaatgtgcatgggtgtgtgtgtgcacgcgtgtgttcccactcggggaatgtggggagaggtgcatggagccaagatgggtggtaaatagtatgtttctgaaattaaaggactaatgtggaggaaggcgccccagatgtactaaaccctttgcccttcatctcatcctctctgacttgggaagaaccaggattttgtttttaagcccttgggcatacagttgttccatcccgacatgaactcagcctcccgtctgaccgccccttggccttccttcttcctcgatctgtggaacccagggaatctgcctagtgctgtctccaagcaccttggccatgatgtaaacccagagaaattagcatctccatctccttccttattccccacccaaaagtcatttcctcttagttcattacctgggattttgatgtctatgttccctcctcgttattgatacacacacagagagagacaaacaaaaaaggaacttcttgaaattcccccagaaggttttgagagttgttttcaatgttgcaacaagtcagtttctagtttaagtttccatcagaaaggagtagagtatataagttccagtaccagcaacagcagcagaagaaacaacatctgtttcagggccattggactctccgtcctgcccagagcaaggtaagcacttcccaagcccctacctccctcccctccctgtgggcctgcagctgtccaggtgtagaaaccgttagtgtgctaccccagcagctggcaggagggagttggtggattcctggaagcatccctggtgagtcatctgctggaacattagtgaaaacttagtactctagggaccgatgtacagtgtccattttaaaagccacctaataataactgtatagcaagatctgtgtgtatgcatagtttgtggaaatgtttgttttatcttattttgaagtggtgtgtattgatgtataaaagtatattcctaaatgttaatgcccatcagttaaaggattgtatagagctaaagtgagtggtgcctgccttactattgaaatttttaaaaagcctttcgtgcattccttaaagtaattggattcataattataataatgttacaaatcagacttgctcccatatttgtgatggtcttggtcgtcagttgtgatatcaaccaaaatgacagctgggatccccattcttgtggattaactaactttggccccagttaaaaaatgaaaagctattattgcttcctaaagagtttttaaatctgtgagaagggggaaaaaaaggtttttttacttgcccaggtaaaattgtgtgcaacaacaatgtcattttaacaaagggattactaaaccccaggtgatgacccactttttcaaacaaggaattgcaagatactagatggaatgtgggtaacctcttagagtttagtttactggaatctgaaattgtatgatttccgtacattccttcatgctactaataagtcatggaatccctctgtgctggactctgggggtaaagtgcaaaacaagatagacatgatccatggcataagagagttcactcagtgtggcagagaagacaaacagtaaagaagagactgtattgttgccattgtagtaaatgctgtggaaggaggggagcaaatagtgggtcctgacttcatctaggcaccatgacacttcacgtgaattatgtcactaactccttaccacagtagcatgcccattttatagatcaggagtgtggggcttaaaggggccaagtgactcacccagagtcacacagttctagaagtctgcctggccctcaaactagggatctttgcatgtgccacccatgccatctgtgactatatctttttattctttaataataactcccttttctaattaaaggtaacaaacaaaacttaaaaaagagatgcccacccaagcgtcattggcatgctgatgttggcaccagtgttgggaagcccttagcatactccaggaagtaggagtgtgtaacgtggggtccctttgtccttcatgcaagggtttcaagagtttagaaaacctatgaaattgcacacacaaaaatgtgttttaatcatcaagactctcagacttaccatgctgagaaatgtgggctgagggatagcgctccctagtatcagctgatgggccagagagccaaaggaggagacccaccaccatcacctctcctggacagtgctctgtggtttcaaatgtaggtgatactaaaatgggagttgcttcttagaaccatggccggggttcccttgaccctgaagtgcagttcacctgagattgtcaaatgcatctgaggcatgcagaggaagtgctgggcacacagctagtgggaatacctcagcgtaagtggccaggagatgccaggaatctccactatttcccttccagtgtgccagcctctgggttttacaggcgcatgtaattgcagtacctctgtgcacatttccctactgcctagaatgactttcttgactatccatgatatataaaacacagataccgaattgttcccttacctcttcctctaggttcaagttaatatgttattggttgccttctataatatgttatctcattgcctttcccaacaagcctttgagataagtattaggtccattttatagacaaagagactgaggctcagcgagtaacttggccaacaagttgctcccactgctcaacagcaaatgagcggtgggaccaaaattcaagcctgtgtctgtttaacttcaagcctgtgaatgtactaaccggtgccctgtgccagctagtactttgctacagtcataacctagactgaagtgatagccatgcccctaaaactccatgctgtggtgacagcactgagcagtgtccaagaaggcttgacttctaggcctgtctctgccactcacaaactttataagggaataaagtacatagcaaggtccgcctagagttagtagcagttctgacaaagctgtaatttgtcaatattccgtcacccaacccaggaatgctcatttttaaggtatttgactgaaacagttgagcattgcccttcatatagtttaaaacagtggtttcagaaccactttcctccagaccatgggtgctctgcaaggtgaatggagttgtttcagaatgtttcaataatcatccctacctcattcgtaagtggcatgtaatttttgcaatcggaagattttcataaaccctggatactaacctagactggtttctatatcagatggtggcttatttaacataaaattatgcattttactatttcatggtggatatatcaatatgttgtggtcttttcccaatgaacactttgattttcaggggttctggaccctgaacatgggttaaaccagtggttctcaaggtgtggtcttagcgccagcagcatctgcttcccctggaaactttctagaaatgcatattctcaggccctcatgcctgctgaatcagacactctgggggtgggactcagccgtctgttgtagcagtgcttccaggttatcctgacagtcactcaaattttagaaccactaggttctctatatgggagagagtagtctttgaacttggaaaacaagagaagctaaacccctacagcaagggctggtgaccaggtcgttgccagaacctgaaagttcgcctctgtattaccgttcctgtccctaacccaagtccttcagttctgggtgctccagcacacactgctttgtgctgcagtgatacaaatgtatggctcatctccccagctggcggggaggcatttaacacactgacttaataaatatttattgagtaaaagtatttgctcctaggaagcgggatccaggtaagccctttttttctctctcaactgcttctagcccagtgctctttatgtagtaagcactaaataaacaactgctagatgttgatccagaaagtcacattccttctctaagctttaagtttctcatcttaaaaataagaggattgtatcagatggcttgccttaggtctctttcagctccagagccccaaataccctatggttctctatttagagatgttcttccccacagactgccatagaactcctgtaatttacttagtatttgcttgacagtatggagaagaaaggggagaatcaagattttatttaaaaaaaaagtagctagaatgtgtatatggttcacaaaggtaacaagaattattgacattctttcttctcttttttcttcctcttccttctcttttcctccttctcttccccctgcttctctcccttcttatagatgtgtcaccagcagttggtcatctcttggttttccctggtttttctggcatctcccctcgtggccatatgggaactgaagaaagatggtaaccagcctctcattattctctgtggaggccccacttctaagccaggactcttgggcagccactggtgggaaatcaaactgaaatgggcaaccatgcactgggtcctctagagaaagccatcactctgggaaaatgcaatgccatatctctcttttctactttgatggtatctatattgtttggttttcacattggatgacattggtacactatggtggggaaagacatatgatatatgatatggtggggaaagacatatgacatatgatattttccaatattactaaaaactgtttcacacaattaaaattccaaagtagaggatttgcaaagtataacaactgtgttcgtttctcattccaccacatgatactgccccctcagttggcactgtgatgacttacctctgaccaagcactttggaggaagcataggattcagactcacattgacttgggttcaagtcctaggtctgtcaatgactggttatgtgactttaagctgggtcacctctaatcctgaatttcctcaactgtaaactggatgttacaaagtggatgcctaccacgtgggttatttagtgggttaatgaatgcagaatacaactcgacagatagtaaagtgaaagtaaatgtcagctagtattactattttggttgtttaaaatatctttcatgattcaagagatactttttattatcccaatgatcagtaaaaattattagtagactaatagaatagttaatggtaaaataaggagttctgcccatccttctagtatctcacactcagtaaatgtgcattctgaccgttggctgtacctgaaagaccctcagatttttatcactgaagccaacatcataatgttggcgattactatctttaattgtataataataatagttaatgtttattgagtgcactgtctcacttaattctcacaagagccatatgaagtagagactgtctgtatcccattttacagatgttggaaactgaggccagagagattaagtaacttgcccaatgtcacatacctggtaagggtggaacagggacttgatcccaattctgtcttgcttcaaagctggtgcacttaaatttgtgaaaacgtttttacaaggacatgaagtaattttttcccaggtctttggagagctgaataagaggaaatggacataaattaaggatgaaaatatttcagctgatgatcagaaataatcttttgatattctagaaagtaccatcttgaaatgggtacctgaaagaaatctgggaccactcctctcttctcaagaattttaggaagacagaatccagccaccccttctccatgagaatttgagagatttagacactctcttaagtaaaggcaaaggcctgagccaggggtatatggcagatcccttccaaccctgggattgttagcgagctcaggaaccttggtcctggcatatttgaccccttagtgacttctgatttggtaaaccacagaaattccagaaaatcagtgtgagaaactctccgaggtgtgacttaggagggcagacgatgcagtgaggctaagtgccaggttcttgatgctcctcttcagctttcctcctgcagctgttttccctgctgttgagcaaacatcttctagggcttccgagcctcagttgggacaggaaagtaaccatgctcttcaggtgtcagggggacaaaaaaaaaaccaagaaaaagccaaaagtgccacatggttttacatcagcacagctaatcatttccccagagttggaccccaaatgcttttgacctcttatttttgttatccattcagtccttataatccaattgatgtaaagtgaaaactttatattctacaatgctttacatccagaggccaataacgagaaccaccatttataaagcatgtaagggcactgtgtatgagcttatataatccacatatccaccttctaaagcaagggctaatatttttctcattttaaagatgatgacactgaggcttacagtagttgaatgtcttgccaaaggccacaagactggagcaagggctagagctgcttctaaatccaggcctctgccactccaaaatgcaggctctcaaccactgtgactcataaacttgagcaggcatcagcaccatctggagagcttaagaaccatataactaaatccatcccaaggtttctgattcagcagctgagaatttgcatttctgatctattccaaggtgatgctgctgatggtgtttcatcgatcatgctttgggaactactacattaaacaattctattcaattaataatttatgcatggattaaaaaaatgaatgaagctttgctatgacacactctgaaatactatactaagccattcctcaaaggccagtttagacactagcattaggcatcccttgcaaagcccaagagacaaaaggtctgagctgtagcccttgtacttctgacttgctgtgaccatgcttagatcgttggcctcagtacgcttcttcattaaatgggaagactaagctctactggactgcttcataagagtgtaagatagctaaaaataataataataataataataatgcagagagaatgaaaatctccactggtgatttaaaacagagggaacgaaatccttaaatatccatggaaaattgttaagagagtttctctgtacagttggctgactcctcagtctataagtaacgataactaacaccgaatttactgtgtggcagacactgtgctaagtactttacgtgctttttttttttttcatttaatcctcagtcaaatgtaaggcagatactgttattattatcattttacagatgaggaaactgaggctcatgataatgaaataccttgttccaaatcccccagctggttagtggagacaggatgacagtcttggttcgttgttctcgacaccctgagcttttaaccactatgttactctgctgaatattgtgccctgccgtattctctatgaaactgaaattgtgctggaagtttctctcccccagacctttggcaaagagtcttgtgctgtttgcagtttttggtatattaaggtgtttccaatctgctaaataatcaaaggttactattaaaggcagccttccagtcaatgagtcgatggcagctataaaactctttgtttctcttttccatgaccttgagcccaagcagggtctcatgccttgagatcatctcagcaagcatttgccaaatacttgttgtaaacaaggttgtgtttaggcaatggggatgcccgaagggttaataaaacacagtcccagagttcctggagcttacagcctggttctccactttatgtgcattccagtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaaggtaattctatacccttggatagtatcaattttctctttcgctcataagagttaaaaacaacaacaacaacaaattgaaaagccaagtcatggtgagtgtaatgaattaacatcaagtctcttattgatgttaattgatgttaacctccattttcctttgctttcctggaccctttgggttatcaaccatcaaaatctcatattaagggagtttcatgatcagtctgaatgcttagcctcatgttttctttaaataatggtgatattatttaatggctaatggaaattaaccgatagtgtatcactctgcactggggtgatagccttcaaaaaatgaatgcctctgccaggcatgttaggtgtgtagtgtactctgcagaatcaacaccccactgggatactcccaatccttatggagctacccaagaggcaacgcatggaagaacttcaccctgtaccatctggtgatctgtgattcatcacaatcaaaacctttctgcaaaaaactcctaaatattgaatttttgtttttttcaaatccagaacccaaaaataagacctttctaagatgcgaggccaagaattattctggacgtttcacctgctggtggctgacgacaatcagtactgatttgacattcagtgtcaaaagcagcagagggtgagtgaaactgctctggtttctcagcatttttctagaactatttcattaagaaattaagggcaacctctcagtgacctatcagttaatgataatgggaaaagcaaagtcaaacccgtgttttttcaaccgcccttccttgtctacattgaagaaagaacatggagattttagccgattgcttgaataaatgtatgtgttggggcaggatattattgggaactgagaatagtctctgctgtgtttgaacccactcatccaaattgcctggccatgcttcctgaagcctcatagcaccaaagaaagggataaacggagaattcaaagctacaaatgacttgctgaaattgcaccttgagtcaaaaataaaaacaagagctccagggcgtagatcttaggggccctgaagcagactccaaaactcgatgaggcctcccgaaattttcccagggccacctcaactccttttacttctgctgacaccactaatctgaagttcgctgttggtccaatgcacctggactttccgtaagaaagcaacttccataaatacaagacctatgtgttaacccccatgtggcttactttaatcatcaccgaagcaaaccccaggtgatcatcctgactttaccattatttcactgagtaaattaagcattggggtctcactttttcatctttaaaaggaaaatgcttactaaagaaatgtttctccaagtgcataaagacataatcagcagaggaatggttaaataaaacatggtacactatactcttgcttaatgtgcagtcattgaagtggataacccaacccatatgttttgtcatggagagctccccataatatgttcagaggggaaaaggatggttacataatcatatgtatacaatttgatcctagttcataaaaataaaatctatatgtataagtaaaatatatatagtggatatatataatgtagagatgtatataacatggattatatatataatgtgtgtatacatatgtgtgtgtgtgtgtgtgtatatatatatatatatatataaaatgtgtatacaattatcttgaatattcattgaaaaagttctggccaggcacagtggctcacacctgaaatcctaactctttgggaggctgagacagaatgattgcttgaggccaggagttcaagaccagcctaggcaacacagtgagaccccatctcagaaaatattaaaaataaaaaaattaggtgggtgtggtggcacacacctgtagtcccagctacttgggaggcagagggaggggatcacttgagcctaggagtttgaggctacagtggggtctgattccaccacttcactccagcctgggtggcagagcaaaaccctgtctcttaaaaaaaaaaagagagagagagagagaaagaaaaagaaaaaggaaggtctggaaggatacaacaagctattattagtacttaaacctgtggagagcagttaaggatgaaggagacatacacttctttcctttatatggatctttatcatctttacttttataattagtgtgtactgatttgtgtattgattttataattaaaatgggaaaaaatgaatttaagtttttaacaagggggtttaataatcagagattctagatctaaaacaaacaaaaacttccatattcatttagtccagagacatgtaagtgctcttgaatttaagctttttctcctggggagggcagtttcttaccctctgggtagaaatcagcccagttggagaaactgtgtcctcagacaacagttgaggccttacctgccttactggctacaatcactaggaactctctccccaatgtgtaacacaggctaatttctgtctttgacttcagctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcagtgagttttggatgattatatgtgctccataaggaaagatactatttgtcacgtgttcacaatgccccatgcactgtggggtaggtggttgacaagcatcatctcttttattctgcatccaaaaacaaaatacgatgtagatactgttatctgcattttaaggaagaggaaattgagtcttagaaaagttaagcaacttgccccagatctcagatcttacagctagccgttcaaatccagatccactccactacagctgctctttactgcactttgattcagctgccagatagtttccatgatgaatcccagagcctaatcaagcataatattcatattcagaaccagggcttccttactaatggcaattattcccaaccaatccttccttagcatttgaaaagggacttctttcttagaatataaacccttccaaaatggacatctttttttttaattggcagatagggatttcaccataagtcatttcctttactatttattcattgaccaggcagcatgataaagtgtaatagaaccagagaacttgcttcaaaacttatggagggtttgtacttggtgggtggggtctagttcacatagggtggccaaggaaggcctctctgaggaggtgacatttagctgacaccaaaaggaaagatgtcagttgtgttaagagcagagggaagcatatgtgcgaagcacctgctaggagccgtgatctttgtgtggagcagtgccaggcctacagagcccaaccacacaccctagcatgtctctgcctcctcttatctagaagacctaattgaggaaggagtctttgtgaaactcactgctgtatccttcatgcacagtccagtggctggaacataatgggcgctcagtattcatggaataaacaagcaaattgagcatagagacaattgactgtaactgctccaagacatgtccgcaccaaaagctatgaaaagacaaaagaaagggcagtaaatagaaaatctatcatctcatccccagggagaggctcagcttagttccatgttcagtgcaaagtgagggattagcacagacagggtggtccttcaatgcatggcccataaccattaaagcagaggtcttctcactgtgcggtcccatctgattgttcagtgatgaggattctgagcatctctcagatcctgcaatacatgtggatctgagatgtggccattgataatgactgccttcccgaggcaccagcgtgagcacctgcggcagaggtgcctcacatttgccagccaggtgctcacagaagttaagtaactatccagtggactcacagctgatcaaaggtgcaagtgagatcataagccaaaaccactgaactccaaagccttattaggaaaataaagcatgtttatcctcttccacagtcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaaggtaagaagtgattcaggtgcagtatattccttggtcagttttacggaggcccaccataaagtgagaagatgaatgatgataataacaatgacatccatgtatcacttaacaacagggatacattctgagaaattcatctttaggcagctatatcattgtgcaaacatatatggtgtacccacacaaacctagatggtatagcctactacgcttctaggctttatggtatagcctattgctcctaggctgcaaacctgtacagcatgttcctgtactgaatactgtaggcaattacaacacaatggtttgtatatctaaacagaaaagatatagcaaaaatacaatattataacaatataggaccactggtcatatatgtgatccttctttgactgaaatgttattatgtgatgcataattacttttcttagcacttttctatgtgtctagagctgtgccaagggttttccatgtttatttcacttaatctacaaaattaacgcaacaaaggtagctgatgttattcttgtttttttacccccttttttgtggaaaagaggctttccttttttccagaaactgtggcaaggtaaagtaaagctgtagctgatgcaggaattttgtgtaggtgttagcagcactgccctcactacgtgctcattggacagtagcccaaccccaagaaaaggatggttggtagccagtagtattatcatcatttcacaagtgattgaagactcagagaggttaagtgactttaccaaggtcacccagctaggaaatgacataaccaagacataaactcaatctgccagacagaaaggccatgcacctaaccactccactacctctgatgttggtcattgatcttggcactcagaattagtcctgatagaggagacctgggctccagaagcctaaaattgttgtttcaactgagtgcatgtaatgaatgatagaacaggcaagagatatcgcccccaaaatggatagctcctggctgttccagatattataaaattattttactaaacagaatgtctacacttatagaggctaagatattggcttcccagcttcctcgccttacagcagaattcctttgcctgttgcaaggttccagaggcccttttgtaccgccccagactcctttcaccccacttttaaaatcactggacaaagccctaattcagcatagcatttagcatgtggtagaaattcagtgagctagttactctctgggaaaataattaggtagggaggctatcctggaatagatatttacctaaatattattttacatcttggcaagtactttccctatttaagatctgtatgactaataggtgatattgagtgcttcctatgtgctaaagacttgctaagagtttaacgtgatttttaccttgaactataattctatgaagtaggcattattgttatccctatttataagtgaggaaacagacacagagaacctaagacattttcctgaagttacacagctattaagtagcagtgccagaatttgaaggcaagttttctgatgaaatgatcaggatatggtatttctcaatatctcagggatggctagagcaaatctgtctctctctcaccatcagctcaggactgggtgagtggccatggggtcttgaggcaaggcaattgtgctagaaagatgaaagctgggccaaacgatttctccctcaagggcttacaaagtacaaaagctgcacctacatgtggagtgtctgccagtaggtggtgcaagttctatgcacacccctgtgaattgcaagcacagtgccctaagaccaagatgggcttgttttgggagagtatgcattgcagaaacaggctcagcttaccctgtgactatgttgccaaggggtcttcacagctttccttctcttttgcagaaagatagagtcttcacggacaagacctcagccacgttcatctgccgcaaaaatgccagcattagcgtgcgggcccaggaccgctactatagctcatcttggagcgaatgggcatctgtgccctgcagttaggtgagcaggccctcaaaggccagcccaggcctgcactctcagtgcacctggatgcagggatatgattgggggctgtgttggagaggaaagggggatggagtggccagcacccagttgccagaatcagaaacatacatttattcactaacagatatttatttggtgcctttgttatgtaggacactgtgctggccacagggatattgcaggaaagaaaacagaccggggttctggcctcctaaagagaaaggcaaagaaaagagagaggtagccaggaggcagagcatggaggacttgcaagcttgcaggactcagaatcttgttctgggggccccgggccctgaaacccactgaagggttttcagcaaggaagtaacacaatcagatattattttaagaaaaccctcaagaaagcctctggcaagcatggtgccagccaaattccaggccacataaggaaggcctgggccttctggcatgaaatccctgaaacccagttgcccaggatcatatgttgtgagaaataagaagagacattgctgttacaatgtcaccccacatcaacttttggcattctcttccaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccatgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatcatattttgggcattctcagctgatttgagtactctgcttgcaagtctaccaggggtgcattttttcccctatcatttaagcattgccctttcttgaagtgatcccattccaaattttgcagagttgctctttccccttatagtatttccaaagtcagtgtcttcctgagctcaggggatgtccctgtaatctgacaaggaaggatcctttgcaagggcactgaactgcattgtgccttttttaggggtggaagctctcacttattccaccctctatcctggaatcgactctactggtatcccaagaatcatgaaataaaactctaacctggtacagccatggacatctcagctcttaggtccagctctagtatttattgagagtttgccgtatatatggacatgtgctagccctcagggttgggaagtttcaaaaagccttgcattgtgtctcccaaacagtgcccactcctaacactgcttataaggcaggatgaaaagttaacttcactatcattacacgctaaaatgttcaggatatatggtagcctggggtgagaatgaaaaagaaggatctgtgtaacccagcaccatccaggaagactcatcagagaagagagggtgccaactttgggctaaagaatgggcagggcctgcaaattccccttggtgcttcccatggaaggaggagatggtgggatcagagggaatgcagtccaatttcctgctatcccaaaaatccaagtgtgcacattcaggcttccttgcaatggcagggtaattataataggggtgtttgtttacattcctgattttcagtgtcccctggagccctatgccactctgctcctggcctggaggaatggtgggtggcttctgtcattctttgccaacctttggagcatatggtcccgtgttataagcccacacttgacagcatatggttgttaataacaagtgtttgtccccctacagggtctttcatctgcagttaccaaagtacttaacggacatttaatgaacaacactaaccagatttttaaaaaataaataactaatcacatttcataagcactgagaactgggacctttccccaaatttctggccagcctggggcagaggtgagatgttctggctcccaccatgcccagtgcttttgcgacatgacctcttagcattcgattaatttcagtgcatgcaatgcagagtttttcttctttaaagatagtctccaggactgtcctttttattgtaaatctagccactacaaaatgtactaaatgtctaagccaaagatcttaggactgggaatcagaggagcagactccagtcccaactatggttacataacagacttgtgaccttgagcagggtgttggaaacagcctgctggttttccaatcaatactcattcccaactgttttctccccgatgccctcttcagctctaaatgttggtaagtttagcgaccactttttcagccacctttgttgcccagcaaagccaaaacactgagttctggccaatgagatataagaaaattctgctgggagggttgctgagaagctttggcttttctgatgaaagacagagccatgtctagcatcaccctttccttccatcctcctctcttgagcagaaaaaaatctcgagaagcttcagaggacaccttgtgcccagtatgaaagccatcatgcaaaaactcaagctagagacttcaggctaggcgctgtggctcatgcctgtaatcccagcactttgggagactgaggtgggcagatcacctaaggtcaggagttcaagaccagcctggtcaacatggtgaaaccccgtctctaccaaaaaagtacaaacattagctgggcatggtggtacactcctataatcccagctacttgggaggctgaggcaggagaatcacttgaacttaggaggcagagtttgcagtaagcagagatcacacaattgcactccagcctgggcaacagagtgagactttgtctcaaaaaaaaaaaaaagaaagaaaaagaaaaagaaaagaaaagaaaaaagccagactccagatcctcatggcatcatggagcagctgaaccaaccactgtatctacctaccccagatttcttgacatgtgagagagacagatccatatttgtttcttttttttattgtggtgaaatattcataacataaaatgtaacattttaaccattttcaggtgtacagttcagtggcattaaatacattcatattgttgtgcaaccatcactccacccatcaccagaactatttaatcagacccccatctatgagaggctgctggccaagtcagaaaaaggacccatgccagcacaggaagaaacctggggtttggtgtcagaaaacctggttctgcccctcacagctggcatgggcctggtgaagacacggagtactcgatttccagagacatcaggtggggctttggtgataccctgcttcgctgacctctgtgaggtgtaaaacaagtgaggacataaacctgcaggccccctcctgaaatcttcaagtgtcatacccttaggagtccgtctccccactcccatgttcaagaagaaagtgagaaaactaagcaccaaaggcagccatagaagctgcctcacgaggtccctaacaaccctgtgcaggaggaattctcatcccattattacagataaggaaactatggccaaggtccctgttccaagggcagcctgagcatcagcaggactcacctgaaggcggggagagattggggatcccacaggaaagcacctctactgtcctttcattcagtatttttggagtccctggtaccgtctctgtccttggcaccatcctcaactttttggatacaggggtgagtgagcccctgccttcccatggtttctcatctccagaggaccaaatgcttggaattctaagcactggaggccacttcctaaggatcaagggcactattgcatgaaataaataattggtttaatgtgatggtcaccgtgcctggctcacaggaagcactcagtgaatggcagctatgtccactgactagctgtgatcttgaacaagttatttaacatcttcgagcctcagttttctcatccttcaaatggaatgatagtacctacctcatagtgtggttgtgaggatcaaatgaaataatgttcaaaaattgctttaaaatgtacctgatccaataagtaaaagcttactgtaaagtaaaatgtacctgatctaataactaaaagcttattgttattagttttattgtgctatttagaacctgaaagaagcataattctggaccctgtgcttcttgcaaggtttaggggatgaaggggtggtttttacctggccttggtgtctctgagaaccgggttggcatggaggaatcattaatcagccagtggggatgagaaagctggtccagtctgttagcatatttaaaagcctctccggtgtaaaatccctttcttgtaaataaaatcgccaaaacgtccccacatgggggtatcaagatgccgtgaaccccgttcttgctttcagggcttgtacagcctggtgagaaacagaaaagggaaatggtggtgaatataataaaatataacctggctactagctgagttaaaggtatgtgcaccataaatatttatttttacaaaggtttccatctcccgggaggagccctttcattccctttcaccttctctggatgtaatgaatttggcataatcctaccaattcaccttacctataaatcagactttaatcatctccgtttcatttcagtgtagtccttcttctagggcggcgtttgggagcaaaatatatctggacaagactttctccagagggtcatattataccaaggaaatgaattccctgtctcaagctcataaaccgcaaaaataaagccagcattctggctgaaggcggaggaaaccagacgcgcacacagaaaaccctccttctgcgggaagcgctgggcggagctgatttgcatttaccttcacgcaggcctgggttccgcaggaggcctagagcgttccggcagcgcgcccgcccgcccgccgcggtcgtgcgcagccactcaacccggtggatgctagcgtgtgacgggctgcagggccctgccgctgctcactaagctcccccgtctcctttcataaggagcaccatcccttcacttctatccatcaggctgcttgcaaaaggagctaacccgggcatgtgggattccaaggaactgaacattccgccagtggctctggggtttggtgaagagggaaagtcgagggacaaatcttgggtaagccacagtgttcggtgagcttcctccttcccacgaccaacatacagataggtgtaatgaagttaaaatgccagcaagagaaacaacacctggaaggagtccagagcacaggggtgcgcacttgatcctgaagcaaggctcacacctgggctcaccacttaccagctttttgctcttaggcaattccttatctctttgtgtgtgtgtcctcacctctaaaacaagtatgctaatagtgccaccatctactgggtgctgtgggggttaaatgagtcaaggctcacaggacccagtgctccatcgcccaggctggagtgcagtggcacaatcaaagctcacggcagcttctaacctgcagcctcaaactcctgggctcaagcgattctcccgcctcaccctcccgcgattgtttttctcagagcaggccaacaaggagaggcaatcctaaagcccacttctttttccctccccatgaatatgaaggttgactttggacatgtacagaagccttccagtcctaactcagaaagctatgtccttccagccaccagccctttgctgggcatacagccagcacacagcagtgacatctccctggaatcacagcactcagagcaatgccctatttcagcaaattattgcatgggtttctgctcaaccttgtagaacatcctccagccatggcttgtccatttccctgaaactcctctttattgagtgtttggggtgtttaagggttaaccagcccaatggtcccccaacttgtttgagccagggtccctttgttcaaatggaaatcttaaatgcaattccaagatacacaggaattggggagtatggtggccaaaggggctttagttgcatctgcaacgttctaatttcttacaaggaaaatatatattttttgcataattaaaagttagttttttatgaagtcctatatataaagtaggcaaaagcagagctgctctggctggagcctcacacccactcattccctgtcccctattcaccactgagagccctaaggcctcttctcaacactcctaaattctgcagaacacagttttatagatgacaaaacagaaggacagagtttggtgccgtgcccaaacaccaggattaatgccagggctcaaacttgagcctgggtctcctgactcccattttggcagttcctgttcaaattcccagaagattgccaactaaagatactttcttttcaacttttcattctgaattaatttcagaattagaaaaatatggccaaaatagttcacagaagtcccatattactatcaccgggtttctctaatgttaacataaacttggtatagttatccaaaacagtaaaattaacattgatcaatactactacctaatagatagaccttattcaaattttgctaatttttccaccaatgtgcttttcctcgtccaggatacaatctaagacacaacactgaatttagtttcatgccctataatcacctcaagtctgggaaggttccttggtcttccttaaccacgcattaccttgacacatttgaagagctaggagcagttattttgtaaaatgtccctcaagtgacatttgtctcatgtttcttcatgattaaatttgggttctacatttttgtcaagcatcctacagcagtaatactgtgcccttctcagtgaatctcatcaggaggggcatgaaatcaatgtctctcagtactggtgaaattaactttgatcactttgtttaggttgtgtctgtccaccagtgttctcccctgtagtactctttttttcttttggaattaatatatcttgtggagagaccctttaagactatgttagtaccctttttctcatcatacttctaccaacagattttgtcatacgtagatgatacttgcttgcaagcaacagtaatttcgcctaatggtgattttctatttctatccttctttctatgtttattagtttgaattctactgtaaacaagaattctttattcttcctatattctttttagtaaaacattcctaacttttgatgttatcagagaccatcatgttgactccacagaacccttggtatctgactctcgggtctgcccggttttgaggtattcacttctgtgccaccataaagaaaaatgccttctttattttgcatttaaaccttatgattttagttgccattaatagaatttttgggagaggagtgtgctaaatgctttgcagggtgaagaggatgttttaattattcaagagaactgcttttattcaattcgggtgtacccacttacacataaaaattaatgctaaatagatgtaatttccatctattcattaaaacaaaccccaaagcagtccagaaatccttagtagcctaatgttattcttggcacttgaaaacaaaactacttttcttaaagaaggaaaaccataacctgtgttttataaaacacttattctcaccaatggtggccttcttgctccttttttccaagtaccctccctgtttccttctcctaagcaaccattcactcaacactattttactgagaatctactgtgtgccggcctcttttctaaattctggggccaaaccagcagacaaaacagacctgaactcccccgttttgagcttccagtttattcaggggagatagactacaaattctttaagtggtagctgctttgcagtaacattaagaatcacaggggcagaggaacctctaatttagatagcatgaacaaggaaagcccctcagaagaggtaggtgtggtgagatttgaacagagaacagaaagaagtgagggagaagctgtgtgccttggggcaggaggcgcatttcaggaaaggagaagcaagtgcaaggttctgttttaggggcaatgattgggctgcatttgctagtgggaggggttgttgtgtgtccccttttgctgtatatatacagccttcttttgctaagtcttgcatttttagtaccttcccatctacttctctctgcttaattttttcaacatgtagttttgaatatatttccttgaggtctgatatagggatggatagatagatagatataaatattaatataatgtatatatagagtctgactccttttttttgatgtgtaactgtggacagcttttaagccttgcctctctctcttacctctctgcaccacacccacacctgggcaagctgctcagaaagcctgggtgtgccctcctttggtatagcatctgaaccaaatttggggtaaagattcacaacaatatccatctgtgctggtcagtacaataggcgccagccacagctattgagcacctcagttggaaacatggcgggatgtgctgtacatgcaaaatacactctgggtctcaaagacaatatgaaagaggccggacaacatatagaccctgtctctacaaaaaacaaaacaattagcccagcatggtggtgcacatctgttgtcctagctacttgggaggccgaggctggaggattgcttaagcctgagaggtccgagctgcagtgagctatcatcacaccagtatactccgacctgggtgaccctgtctctaaaataaaataaaataataaaaaacaaagatagtatgaaagaatgtaaaatatcctattaataatttttaagttgctgggcacggtggctcacagctgtaatcccagcactttgggaggccgaggtgggtggatcacctgaggtcaggagttcgagaccagcctagccaacatggtgaaaccctgtctctaataaaaaatacaaaaattagccgggcatggtggcaggtgcctgtaaactcagctactcgggaggctgaggcaggagaattgctggaacccgggaggcagaggttgccatgagccaagatcatgccattgcactctagcccgggccaacaacagcaagactccgtctcaaaaataataataataataataatttttaagttgattgtatgataaaataatatatatcaagtttaaagtattattaacattaatttcacctttttaaaccttttttaatgggagtacagtatttttgttttgtagagctgggggttctcactatgttgctcaggttggtcttgacctcctaggctcaagcagtcctcccgtcttggcctcccaaagtgctgggattatgggcaagagcactgcacctggctacattaaattttttaattaaatatatgactcatatttgtcattcaccttctacttctgttagatagcattaacatataccaaagtagtgacaatgactatgtcttagtttgttacttttttttaattccttcttttggattctctgtattctctgagcatgtatttaaaaataaaaagacatttcttggagttgttgttggtggagataggaaggccttttggaggatctgagaaggaaaggtctccctacccaaaaagtccagaaagggaaaacattttccaatcagccatgattctgaaactgacatctgccctctctccactgtttaattaatctaaacttgatctgaggctgactccataccttgagtccctatgtaatgaactgcatgcaacctaacttggtatgaactgactgaaagctaatttaatatatttttgtagctaatagctgagcctcagcagtaaaacacagcagcaaacctccaatcaattataggttaccaactgatcagaccatgctcaaataaagcaaacacctagctgtaaccaaccaagctgtctctgtacctcacttccattttctgttcatttgctgtcagcccatatcggggagcagagttctctcaacttctgctggttctgagagctgccctattgacaagtcattcttcgctcaattaaatttggttaaatttaacttatctaaagatttactttcaacactgcacatatactgttagagacaagcagcctctctctacaagcgttggaataaatgactttcttatggtgactctggagtttgcaaatgcattggtgtgccttggcttgcaagccctggctcgttagcactgatatgctgctgtcataggaagcccaaggtgtggccgactacgactttcctgtgtagtctagggttgccatttgtgcttaatccaatccatatctactctctacaagccctcagtgtcccagatccttgtccacaaacctggaggaccaagctggggatggctgtccaagcatggatcaagctgctttgcagactgctttgcagggtaatgttttggaacaaactgtacagacttagtcatgcaaaatgttattgtattgaagaggtcagaattcagagcacacttggctaatccagcaactgaattttactactactgactctgatgaacagaaaacaactctgccacctgtacacaggcagtcaactctttctaccagaagaggaatggacagtaagagaaggcagaacagggggaagaaatcaaatggatttaactagatcatcacataaaaactgcaaatgtcctatcatttttcagaaagattcaatgtctgctttcaaaggattttactatatgtatcttctttacacaagtacattttaaaatttaagtccgagtgatttcaattctgtaaattttgaaatttcactgagtaagaaaaatactgactactg

SEQ ID NO: 14 - DNA, 113312 bp, Homo sapiens
gcactttgggagatcaaggaaggaggattgcttgaagctaggaggtcaagaccagcctgggcaacatagcgagataacatctctacaaaaaacaaaaaaattagccaggcatgttttgtgcacctacagtcgtagttattcaggaggctgaggcaagaacatcacttgagccctagagttcgaggatgcagtgagccatgattgcaccactgcactccagcctgggtgacagagcaagaccctgcctctaaaacaaaacaaaacaaaacaacaacaacaaaaaaacccaaaatcccctctgattgtttgaccttaatccaagctcttaaaaggaaaaaataaagtttagtctacctatttgtaatatcagttacatttgtagttccacatgtttttctgatttttttctaactgaagatttctacttcttagtaaaacaaaagcaacaaaatggaaaagacaatgtaagagttttaataagtgcctcaaaaattatcatttcattaaagcgatgaagatgggttgaatctattaatatcatttattgtgtttgcaaagtgcttctgtttttttgttctttgtttttcttacattagaattgcttttcttcattgctctgggcttcagcagcctccctcctgttcttcaaagagttctgcatgggctgcctctattcaatcaaatggaatctccaaagtaacacattgaatgggatgtgcaacgaatactaaaaaaagaatgaatctgcaaatacttagcagctggcagtttcttaaaatcctaatctcttcatttggtgaaacagaagtgatttccaatttcagcaactaagataaaataaatcttctatattgaaccgcaaaataaaataaatgctaaactttgtttaaatgtagataagactgggtgcagtggctcatgcctgtaatctcagcactttgggaggctgaggtaggaggatctcttgagtctaagagtttgagaccgacctgggcaacatggagaaaccccatccctacaaaaaaatatattttaaaaatctagataagaagagatttgcaataagtatcacagcaaccgttatcaaatgaatatcaaattttgcatgtttactatgagatcctgaacactaaaatgaaagatcaggagtatgacaggaatttagggttgtgctatttaatagttggacaaaaacacttctgcactacctaagagtgcatgcttttagagttttctagtcctgtttcctcgcctctttttcactccacttagtccactgacattttctgcctctcctctcaggtacctagtattcctattcttactgtatcaaaattcctccagtgcctacttcatgctaagcactctgccagtgctttcttcttcttctttttttttcttgacacaggatcttgctctgttgcacaggctgaagtgcagtggcccatctcagctcactgcaacctctgcctcccaggctgaagcagtcctcccacctcagcctcctgagtagctgggactataggcacacaccaccacacctggctaattttttgtagagattgggttttgccatgttgcccaggctggtctcaatgtactgagctcaagtgatccactggccttggcctcccacagtgctgggattacaggcatgagccactctgactagcctgccagtgtttccaaatgttatttaatttaatgttctcaacgaatggccagaggaagatattaataggatcttttttaaggaaaaagaaactgaatcctcctggttaagggtttgctggaaaccacatagccagggtctgagaaaggtggattctttttatttatttatttttgagacagagttttgctctgtcgcccaggctggggtgcaatggtgcgatctcggctcactgcaacctccgcctcgccggttcaaatgattctcctgcctcatcctccctagtagctgggattacaggcgtgtgccaccatgcccaactaattttttgtatttttagtagagacagggtttcaccatgttggccagactactctcaaactcctcacctcaggtgatctgcccgcctcagccccgcaaagtactgggattacaggtgtgagctaccgcatccagccagaaaggtagattctaatctgatctgtgtcttctaatgcccactgttctcccattgcttaatatcaccgtatgttaggctgttcttgcattgctataaagaaatatctaaccatccttttcttggggttgcactactgtctaatgagtgcataatgagggcagtattgctaacgcctatacaatgcacctgcatcaactagaactttgctttaccttggtacaatttttggaaaaatgaaaaacctcttttccatgaaattgaaaaaaaatgtttttgaaaaggaagaaaaaaaagaaatacctgaggctgggtaatttataaagaaaggaggtttaattggctcacagttctgcaggctatacatgaagcatggcactggtagctgctttgcttctggtgaagctttgggctgcttacaatcatggtggacggtgaagcaggagcaggcatctcacacagggagagcagaagcaagagagagagaagggaaaggtgctacacacttttaaacaaccagctctcttgagaactcacttactacaaaagagatggtgctaagtcattcctgagagatctgcccctgtgatccagtcacctgtcaccaggcccaacctccatccaatactgaggattacaattcaatataagattagatggggacaacgttcagactatattacaccactacatgttctagcgtaaatacatattttactaatgttaaatcaaatgtataatagatcattggtttggactgagctcctgtactaggcccaacagacaaaaccaaactggagtcagtcatgctgaagttccacactaacctgctgaaactaagatctttatctgacctttcaacaaatcaggacacagagataacagccaaatccctaaacaggccagttttcgccagcgtgataagaaagttccttaaatcaacctcctctgctcagctcatcagaacactcactctgttttatagtatgaggtgttgtccgattctagaattgcaaataaaagacaattaaaattttttaaaaatatttttaaaattctttattctttttaatagtgatagggtctcactatattgcccaggctggccttgaattcccaagctcaagcaatcctcccacctcagcctcccaaagttttgggattacaggcatgagccaaagcacctgacctcaattaagatctttttttttttttgagatggagtctcgctctgttgcccaggctggagtgcaatggtgcaattttggcctactgcaacctccgcctcctaggttcaagcaattctcttgtctcagcctcctgagtagctgggattacaggcacgtgccaccattcccagctaatttttgtatttttagtagagaaggggtttcagcatgttggccaggctggtctcgaactcctgacctcaggtgatccacctaccttggcctcccaaagtgctggaattacaggcttgagccacagcgcccggccccacataagatctttgaactaaatttgttgtgattttgtcttttgacactaaacatgatacccagtctagaagtcataaagaaaaatggcaacagattgactgcatacaattttaaaacttttgtttggcaaaagaaaacatgaagataaaaaaataacacacaggctgggaaaacgtatttagaacatatataacagaaaagatttatattaagcactcctgcaaatgactaagactataaccaacaactcagtagaaaaatgaccaaataatataacaaaggtgaaccaaaaaataagaaatacaaaaaagcaataaacaaataaaatattcaacctcatcttctaaaaaaatgcaaacaagatacccatcaggttggcaaacattttacgtactaataatattggcaaactctttttagagaaataattggtaatacttaccaaaatctaattttttttttttgagacagggtcttggtatgttgtgaagctggtgttggactcctgggctcaagcagtcctcctacttcagcttcccaagtagctgggatcacaggagcacaccaccacacctggctgcaaaatgtaaatgattttatcttcctttctgtctcttggcccagcaattccacatttaggtatctgtccctgacaacctaacacacaaaattcttatatgtgtataaacatatgtacaagaggaattattaaaggaataggtgtactagtgaaaaattggaaataacctaaatgttcattaatagattaggttaatatattattgaaatttattctatagattattagggcaattgtttaaaagaataaggtaaagctacatataatgacatgtgaagatttctgagacatattgttaggttaaaaatagcatgtcataggacaatatcatattttatcatttaaataaaaatactaggaaaaacctcataatttgctgagagtcattacctttgatgatggggtaggagtgggaaaaaaaggagtgaatagcaactgtcacttttcactccatttacactggtattcctttgatttttaaaaagtgtgttttcatgaattactgtgtagttcagaaataaaaatgcattccctttattttactgttgcattctttctctcttgctctcctctaatacaattctcagacaggatgtgaacagaaagaaaacagtaacgtttattgacttccgtacctcacacttgtgttccagtgtttggctatttatgatttccttcctgtgctctgacagtctctaattttaggtatgcctttatggttagaaacagcattttgttttgcttgaatttttaaaccaacaatctcaggaaagagttatgcttctgtaacactgttgtttagggttcccccccaaccccgtctcataaaagtagcccagaatacttttactaccccagacaaaaatggaccatttaagaataagttcctaatctgttgctaaatgctaattatgagaattagataataacttgtattcctgaaaataatcataatgggaatgcatcttcaggaaattgatgggaattctggatctaaaaggtgcagtgtggttatcttaagttgaaaagtgaaattagcaaaatggctaagaaagccttaacataaaacattaattggggtttaatgatgtaatcttagcagtaggaaagacacataataacattctgtcaaacctttgttagactttcttgtaattttgtcttaactacagcatcgaagaaagttgtgtacaattcattttatgaatcagaacccaattatgttatattgttttcattcttttacccaagagagattcataagttgtttttaatcacttcttttattttaaaccaatagtgtctgccaaatgggtaatatttcccattaaaacattatcttctataattggtataattgcttcataaagagataaaccacagcataattccagagtctttgggtttataaaatctaattatgttcacaacacagtattttattcttagtgatcttaaaaagaacataaacttgaacaaagcccagacatttatggtaaagtaattgggagaagcaagttaattattgtgaatagaactgcctctattagcagcctctgagagaaagccctttttgcagtcattaatctcagtataggaaggtttggttttggtcccctgagcctgcgttgatagcctgtggctaaagtgcagagtaaggttcagttctaaagcacaggcttctcaaggttggtccagcatcccagtctcctaagtatagaagagcacagctcctagcctcagcttttcatgttgcttcagaggcaagggcggagaagagagagggagaagcagagggcacaggtatgacctccaaggtctgtttcaacaggagatttgctttcatccgttttacatttaaggattctacaacagattgcttttttttttttttgcgatggagtctcgctctgttgcctaggctggagtgcagtggcacaatcttggctcactgcaacctccacctcctgggttaggcaccgccatgcccagataagttttgtatttttagtcgagattgggttgcatcatgttggccaggctggtctcaaactccagacctcaagtgatctgcccacctcagcctcccaaagtgttgaaattacaggcgtgagccactgtgcctagccaacagattgcatttggagaaagagaatcaattgctaaaattaatttttgaaaacttttgctcaatgccatagtcatgtgctgtctctatgtcaaagggagaatgactaaatataagaattagccactcaagggaacacactggaaggccaaacagcaacccacattacctgaaaaccacaccttaaaaactcataagcctctcttcaatactatttataactaaaaagaaatcctaattttagtctgggtgcagtggttcatgcctataattcccagtactttgagaggccaaggtggaaggattgcttgagcccaggagtttgagtccaggcctgggcaaaatgatgagactctgtctctacaaaaaatttaaaatatagctgggtatggtgatgtgcacttgctactcaggaggctgggataggggaattgcttgggcctgggaggttgaggctgtggtgagctgtgattgtgcaccagcctgggtgacctgttaaaaaaaaaaaaaaaaaaaaaggaaagaaattccaattaaacacacacacgcacacacacgtacacacctgcacacgtaccaagcaaacatccctaaactgtacttgacttgcacctcctccttggtttttatgtaagaaaagggagggagagggagagaaagatactagagcaggaggaaacgatattccttagtcagcattagtgttgtccagaactatgacactccattttgcttcagcattcctaagtatcaacctgcctttctttgtatttctcttcccttcctccctctgattgataccttgagaggctttttctctcttcttccttcccctttacccataccaagaagcaggacatgcccctttaggaatcagcgacttaaaagattgtgagactcagagaaagaaagttaataatagacacaagagctagatagaaagatgaataggtatgcacttgtcctcagaatctgcagaaaattctggcttaagaaggttaagatgggaggtggggagtggtcagggtggaagataatcagtggcaagttgtacgggagggaaagaagtaaagacattagccactcaaggctttctctatagaaggatttgtcagtggcaagctggctcttacctgagactcagatgaacatcagtatcacttcctgggagtggtctttcctgaccacccagtgtaaagtggccaccgatttgctatccaccacattatcccattttacctctctagacagcacttattatctgacattttcctttatttttttctgcctctctccaccccctacctctggcctcttcccctactaaaatgtaagctccttgggggcaatgacttgtcctaatttactgtctgtctcttccccctaggatataagccccaagcctgcagggattgactggttttgttaaatccatatccttcaaatggccttgcacatataacagtaaggacattcagtagttcaatgaatccttcttgaatacaagaattatagaaagaaaccctttctcccccgcgaagtttgcattgtgataaagcagcttgaatttttcccctgagttgggacaaaggcaggtacattgctcccattgcaggtatagcctcaatttctagtccattgggaccaacaagggctaatggcaaagacagaatcagaagtgtctcctttgtgctgaatagtgatgtgggttaagacaccacagaatgagaaagcagcttccttcccactctagggggcgaaaaggaggcactcgctgcagtggaaacatttgcagaagatcaaacaatgctgtaatcctttaagcttgataaaagcttttttcatgtgtgatagattacaattatggtgaaacgtactataaaaatattcttcacatgttaccagacgtcttcatcaggtttgcaaacatcaaagatttatcttagtcttttgttatttcaatctcaaatgctacctccttcttggctactttatgattctccttttgcaaaagaatcaagcaaaggcatacggcaatttacaagtcaaggtatttaagattagcatttcattagtgatttaaaatatattcctttcagaatatgcaaagtacaaaaaatatatacatattttaggataaacagaatagagtttatctgggggataacttttttttttttttacactatgtaaaagtatcaggggatacttttttttacagtatgaatagtaatacccttttggagcaaaatggccttagtaaatgataaaaagtaaaataaagaggattgtcagtgcaaaaaaaaaaaaaaagataaatttctgatgaattacttacatgctggacattaagtagtcttgagtgaccatatgatttattatccaaataagggatgcttctgagagtgaatgagggcagttattggtcataattaacaataggacaatggacagaaaccagggcaaactgggatatacagtcaacctcatttcaaggatacttaatgaccataaaattgcttttagatttttatcaaaaaaaaaaaaagtaaaacaaaatagcctgctcatttgctaaagacatagtaagcaatgagtctttttaaaattaactgcttgatttttcataataaaattaaatgactaaatatgagtataaattgacaactgttggaggagaaaaagaaattcagtgtgtaatctacctattttaatgaatgaatgaacgaatatttatttattttttagagacggggtcttgctctggcacatgatcattgatcatagcgcactgcagtgtctaactcttgggctcaagtgttccttccgcctcagcctcctgagtagctaggactataggcatgaatttacatgccctactctaccctattttaaactgttctgatcattcagaaaagttgtccttgcccataaatattaatcacaatagtctgctgggtaacatttctcagcttaaaatatgtatttcatttttaaagatcaaccacttttccatattgacatcattggtagatagatttaatctcctactccagtccttatggattgtggccataaggaacactgcttgggaggcttctgagggcacttgtacagctcagtagaaaggcctgttctgattggctggtgatatctgcaggagacatgggatatggggcaatggtaggttcagcaagtatttgccatcaaaacaggtactgaacagatacctgttttaacaataattttctaacatatatctggtttgtaaacaaaaaattacgtcttgctgatcctgcatctgttacctctcataggttctattatagtataaataatatcccaactatgccacaggaaaacaaggccatcactcttgacttaagtgaagacagcaacccatgattccacacattattgtttcacagcgctgttagtcccaaatcacactaagatcaaatccctaatacctggagagtaggggaaaaaaataatacagcaaacgactaacttctcttctgtttctattcttcacttattttgtcatttggggctatatttttatctactcaagagaattttaagtgataaaatgaaaattaaacttgcctctccctttgcaagcaagtattagttattctttttttttttttttttttttttttccagacagagttttgctcttgttgcccaggctggagtgcagtggcacaatctcagctcagtgcaacctctgccttcctggttcaagtgattctcctgcctcagcctcccaagtagctgggattacaagcacctgccaccatggccggctaatttttgtaattttagtagagacagggtttcagcatattggccaggctggactcgaactcctgacctcaggtgatccacctacctcagcctaccaaagtgctgggattacaagcatgagccaccacgcctggcctaatgattctattttaaaggaaaattttcagcatttattttactaccaggtattttgcattatttaccctttctgtacacaatagagagctgttttgcatctttcaatgagggaaaataaagaggaaatagttgactctataaaaaatacatgaggcgtccacataatgctgtttttgtgcctgtatgtgtgaccatgaagcatgttccaccttcgggaccttaattctctaattttaagaaatgaggcagaagaatggctaaaattaaaaaggcatggagctcccgggaattcttacatggtgatggtaggagcacagaaatgtcactactctggaaacaagattggtagaactgaaacatatgcttatcatatggcccagcaatcccctacctaggtatttatccaagggaaatgaaaacatgtgtccatgtgaagatttgtatgtgaatacatttttttcaaaaagaggcagaattcaatttctattgcagggaaaacccaagttcagattgcaaggcagctttctcatattgattttgaccacacagctctacttttccaagagtgaaatcctattgaagtggctttccaaaatattttgtggaaaataagtattaatagatggcaactcctcattcacgatccccaaacaggagacaaattcatcaggaagcagggtctgttctggaatagtttcactgggtgaatcattttccaaaagcatggtggtttcctcctctactgagttttgtatgtcaggagaactgcattctccttgatttaatatgaggcttaattctccaagaaatattgtgttgcttagtgaattcacacttgaaacagaaaaagcaaaattaggatgcttttgtaacctgggattatttcctgagtctaaggaatcaactggtggtttaagtgttaaggaagtaatttcattattattgctgagatggcttccctcaggcagaaaatttgaaatttggggtttatatccagtgttgagatcaggaatatatacaactgtagtattgtcgaatagcgagttttgcgggtagtctcttgtctccaggggtcctgtattctccttcttgtagtctgtaggcttgtgttctgggatgaagatttcttttatctctgtaatcatgggatcaacatataggacctgctcactggaattattattcataagttcactattttcctaggaaaaaaagacatcattttattttgcaaaagacatttaaaagaaccaactggataattgaatgaggataggaattttgctttctttcaactttcctttctccctccattttctcatattgtttatcttcccatatgatttcctccttttgtcttttgttatcctgcttgcttccaaatctttattaaatttgcatgagaagactgaagaaaaggaatagtaaaaataatccacttcttaagcacatttcttggtttaaaagttttaaagagaaaagttgagtcttatatattaacttattacttattacttaattttagggccttttaaaagttggtcttctgaggcaagaatattaatattaatatttcttgttacaagaaaatactttgttgcttaaataaaaaaaggttggggagaatcctattttgctcacataccgagaatgagtgtgtgacaaatgcttgatgccgaggttctaaaggtggataaggcctgtaatcccagcactttgaggccaaggcaggcagatcacttgagatcaggagttcaagaccagcctggccaacatggtgaaaccctgtctctactaaaaatacaaaaattagccaggcgtagtagcgcaagcctgtaatcccagctactcaggaggctgagacaggagaattgcttgagcccgggaggcggaggttgcagtgagctgagatcatgccactgcactctagcctgggtgacagagcaagactctgtctcaaaacaaaaaacaacaaataaataaataaagctactcacaattcagacatgtttgtgatgataaggagggtgggtgaaggttttagcctgatgacttttctgggcaataaatggactggaggccttccaacagatggctggccttcctgggcaaactgtcacccaacacaattataatattatagccccctgttacggactaaacgtttgtgtgccctctccccagcccccctcacattgaagccaatgtgatgttatttgaaagtggagactttgggtggtaattaggtcatgagggcggagccttcatgaatgggattagtgaagaagagacaggaaagagatgatctcttcctctgccatgtgagaaggcagctgtccacaagacagccctcactagcaagtgaattgactggctccttgatcatggacttcccagcctccagcactgtgacaaataaatgtttgttgtttaagccacccaagccgactaagcattccttagtctctcgggcagaaaacaaaaccttatctgagggaagccctaaggtttgcctctaattccaggagcccagaataggaaaggagtttagcaaagaaggagatcttgaataaacagacatgaagtgtcattccaattttcttcagccccagcctccttagggagcttgccaggtttgggtaagaacagcacattgggtattgcttcatcaaaaatcttgacgtgaggagtggctggagtaaagctggaatggtgagtggatcagatcacagaagtcttgtgttacagaactcagactctattctgttgaccagttgtttttgaacttttaaaaagtattttatttttagcctagaaaccctttgttcagatgacatgaggttggggaaagagttagctaataggcttaccagagcttgaaacagagccacttctatttgttttacaaacacctcatcttcttacccaacatgcagttctaacccccaggggtccccctgactttgaattctccctgcttctcctgagcagctcctctcctttcagtgtttcctttccactcccatcacatgtttgggctcatttctatcattgcacttacatcactgcattgcaaggcttggatgatgtgtttgtcccttggactgggttttgagccccttgacagccaatcccgagggccaggggttatcaggaacacacatagcttgttccttccctcctttataatcagtaatgtccctgtaccctcaggggcttcctggtgtgtggccttctctttgccagaatggaaacctagcccacccctgtgacactattgttcacagttctctcacattgcttttctcaaattccactgggtttaaagagtaaaatgatgcccttcttgggctccacctggctctccatctcatgtgaaacagaagccctttgaatctttgaggctcatttcattgagcttttcttccctactccctttgttcctgaagacatctaccattgtttggtcaccaggtgactcgtgcacaaggcccacaatcttccacttcacttttctcttttgaacaggtttgtttctttatttcttctctgttttctttcccccaactctattgtctcatctcttttaagtatgatttgaaacaggtacagttttgtctttacacatgtctatataattatgttaatatgtgtgcacatttatttatttgaatggaaattctattctaattattagactgcactcttggtctcaattgccactcagtttttgttggatgatgttaggttacctgtagcattttcacaacattgctgtttttcatattaggaatatcttcataaagccactttggtattaacaataagatccttcttttaatcctaaaaaacaaaaatgacacgttagaagaagcaggcaatcatataggagattaggaagtcaactagaataaaatgtatattaaaaatcaaatttcctaggtcgggcacagtggctcatgcctgtaatcccagcactttgggaggctgaggtgggaggattgcttgagtccaggagttcgagaccagcctgggcaacatagcaagaccctgtctctacagaatattaaaaaattagctgggtgtggtggtgcatgcctgtggtcccagctacttgggaggctgaggtggaaagatcgcttgagcctgggaggtcaaggctgtagtgagctgtgaccatgccactgcactcactctgggcaacagagtgagaccctgactcaaaaaaaaaattaattaaagaaatcaaacttcctgatgccgaggctaaagttttcatctcttacttaatgaaaattaagtgggaaattgtgtcattatcttttcagattttcctctcatctctattgctctgcttcttttcaatgagcagaaacatttcaaaacactcacactagattcaagataagtgggagaaccaccctagcagtgaaaccgtacacatattaaatagagcaaactctcataaccagaagattcccatgtgggaaagttcgaaaaacttaagggatattttgtagaactttccaaggtgaccgtaactaccgcatatttaaaaagagaatgttatataataaagccctaaaatttaggctgttctgagtctagattttgtaattatttcaaatagggttgtaatgatggtgacagctccaaactttcttgatgcggatggagaaggaggctggggaacatgtcttgcagttgtgtggcatagtgagaactggtttctacctagaccatgtgcttattttaaggatcagtggggtggggctttggaaagaaaaggtagaagtcataaacatcccactttttcccccaagctatctattagcactgccattgtgtttaaaaacactctctgcattgacagtacaaattggtttgggcagaaaggttgtaccaagaacttagaagagactaaactgatctcagacacctttttacatattaacaatggatcctgttagcaacggatcagacttatttgtttaaattggttctcaaaggacctgtactaaataacaaccaaaatggctgagtgaactttgctagcccaatttgaccttggactttagggtaaatattatttctttactcatctttatacaatgttttatgattccattttttttgttgttgttttgtttactaattcacactctcttctgtatttaaaattagaccaaattagtaaattcaggctattggagtaaagtttttatacagtacactgatacagtgagaatatatatatatatatgtatatatatttacccacttttggttttattatatttaaaatgttttgggccgggcatgttggctcacacctgtaatcccaacactttgggaggcaaagacaggcagatcacttgaggccaagagctcaagagcagcctggccaacatggtgaaatcccgtctccaccaaaaatataaaaattagttggaaatggtggtgtgtgcctgtattcctagctacttgggaggctgaggcatgagaatcacttgaacccaggagatggaggttgcagtgagccgagattgcaccactgcactccagtatggatgatagagcgagactctgtctcaaaaaataataataaataaataaataaataaaatattttgctttctgttgctcacttctgtttcagaactaaggcttttatagataatgaatagttgtattaaataaaagtatctgttcaaatgtaaaataaatatattggaattatgtcttgttttatctttttaaaaagagtacttatttaaataattaaatgagcaaagaattgccctaattccttgttatgaactgaaaattagtttttaggctattcttagttatgaacttagtgttacttaaacttttacactagggcatgtttaaataataacacaaatattgatttttttatggggtattaatttgaacattaaaatatttcaagggacttcataatcaagtatattttaaaacagcctcaaataaaattccgtattagtttgccttccttacaagggtattaggaatatgtttattaatgtgtaatttaaattttgaaatattaagttctgagcaaaaaacctatgtagataagaaatcattagtagactttataatagctcatttaaaatctttctactgcacttgattataaatgtaaacgaaagaaagattatttcatgaagcaaatgatggcaagaaggagaaactcagtgccaattcggcaaagaacattcaagtcaaaatttgtgagcaactggacacactggggaactgccacaccaaacaactctaatctatcgagcagcttagaaatactcaatgcatcagtaaaatttagaaatccaagggtcttgcttttctcaaagtctcattttaaataactaaccatagatctttactaataccatcacaggagggaaaaaactgaagggggccaagagtaagggactttggggctgaatgctaaaacactaaaacaattggtaaggaattgacaaatttaaaaattgtcacacttcccttcacactgattcaagctgatttgtttgggtggaattcaagtgttaaagcaaactaaatatggcctgagaaggacttcatacctctatatttgaatccctgtggatgaactgtaacctaacttaacaggcagacaagagtgaaaacctgacttaggagtatgtgcctgtaacagtaactgagtcttggccaatcccagtggaccatacttcaaccactcatagactgctaaatgttcaaactgtgttcaaataagacaaatgccaacctgtaaccaaccagctgtttctgtacatcactgccaatttctgtatgtcacttctcttttttttttttttttgtctataaatttgttctgaccacaaggcatccctagagtttctctgaatctgctgtgattctgctgccaaattcccaaattgttcattgctcaattaaactcctttaaattggctgaagtttttcttttactagatggtgtcagaagcgggatatgaattagaccttctaacgacccccaggagcactgagtgaacaagcaaggaacctgttggacctacttgtgtcctttgatctctcagagtggctggggatcatggcaagttctcttttggatttcagagctccacagatttgtgttttgaactctccaagtttctttgagcaaattcctgttccaaactgggttcagaagtcacaacagaaactggactgggtccaggattggatttgatcagtaattaacaggctaggatccaattagaggcctcttagatttgactaggtcagaaagaaactggtagtaaatggtagtattgcaggggttgtaaaatttggcatttggaaattcacagggatttttggttttctacacctttgtttcatttttcttgcacacttaggtaggaaaaatcattggctaagttcatcaagggaacctgaaagcaaagccaatattttaggtaaaaatgagatccttaatttctgaaaagcagagttccttccagtttatacattaggcttgggaggcagcaaagtcttacagaaatagcaaaattttactaaagataacttacaatggaacattccaaatgaacaacaacacactgaagtgcattaaaaaaaaactggatgaggtctccatcttgttttacattcttgggagcttgactttgtaaccacgtggtggtactttttcttggtctctgccttcaagggaacaggaattttagggttcatgtcacagttagctctaaaaattaagttgagtagttaaaagcttttgcaagctcaaaattaagtactttagagcccttctgggaagcacaatggagactacccagtactgtagctcagtagctaaagttttttactttcacagtggtggcctgggttcaattcctgggttaaggaatgagtcctttctggtttgatacctgtgggaactttatcatttgctgattctcttcccttccatgaattgtcttgaattttcctttctctgagcacctgggaggtaaagttcaaaagccagaaatacaggccacttggcatggctaaagttgggtaacaagagatttaaaaggattttttaaagagcactatagttaagagtcagcttaattaaaagtggatatccaagctataggtatatttaaaaggcctttatgtcttttcctttttttttttttttgagacagagtctcgctctgtcacccaggctggagtgcagtggcatgatctcagctcactgcaagctccacctcctgggttcacaccattctcctgcctcagcctcccaagtagctgggactacaggtgcctgccaccacacctggctaatttgttgtatttttagtagagacggggtttcaccgtgttagccaggatggtctcgatctgctgacctcgtgatctgcctagctcggcctcccaaagtgctggaattacaggcatgagccactgcgcctggccacatttatgtctttcctttttgtggatcttgttttgctgaaaaaggttttttcttctcagtcgactgaattatttttctccattttgtcttgccactcttaaggcacacatgagaggccctaagataacttctgatagcctaggactccttgggaaaaataaagaaggtgccactgatcctgttttggaaaaaaccctctgttttcctcatggaacctcaagaattaaaagcaaatagatctctctcgaaatccattttgccttccagctgtgcctgcttattagaccccagaaactgcatgttttcctagccatttcttgatgggctccaccccaaggtcagtaatccaatgaagaaactggcaaatgaaaaatcctacaactactggatcttgttctctgtgtagttatatatgtgttgtgtgtgtgatgttcatataaaagaactctaagtaattggcttaaagaaaaataagtgcttagataaaacacttttggaagaaaaaataaaaactgtaatgtcttagttcaagtaactttagtaatctttgggaaataaaaatggctttaacgattattggtaaaataaagacattttgtctaaattagacaggtcagatattaggtttactaatgctttcaggtcataaactgctttgacttttgaaaattgttcaatttacctatcttggaggcattagattctcaataaggcctggggacatgtggaattagccatgctcccctagctatgcaaaaaagattataaagaaaatagattttatataagaaagaaagttgtatggtaaattcttgtcctaaagtaaaataactggttgcttaaaaagagggatgattaggacaagtcagaaagtctaagcatgtcatagatggtctgcataagtcatgaaaggatacatgaaaggaaatttaggcaccaaaattaaaagttgctaacagttaccattacaacatgtaatccagactactgaaaatagatttacatgcaaggtgtgtcaggaaactaaaatgcgtttttactaaaaggttataagaaggcacaggaatgtaaatttttgtctaggttagagggttaaaatattgttttaaattagattaaaataaagctaaaggcttgaatacattgtggaaggtttatgaaaagttaatcttataaaaagaaattctgtgtggacattggctaaagataaaggggtattgctaagtttttctataaattaaaattgaaataaaagcacaacatgtttttcttagagcactgatctgctttttaacaaaaatttgtaaagggttacaaaatgtttacaagaatttcacctcatggtcaaactggttaagcattatatcaagtattttaaacctttaacatattttataggcttcccaaaatgaaatttcagcttcaaaattgtctttctaacccccaaattttggatgctacagagggcccttggagcatccaaaggagaggtaaataggattatctgacatgtttagttacatgggattgtcaaaataaaaacaatgtttaatcttcttcaggttaaataatattaatatatgttccaaaattgtataggatttctaaaattctaatgtctgagtatatcctttcaatcataattaaggttattatgttaatttatcacagaccacagagataaccacatttccttgtgaattgtgtttttaaatatcactgtttaaagtcattacattaagttaattacttaatgctaatgcaatttctgaaaacttcacaaacacggaaaatcctagaatatggtatcttttagaaagttcatgaaaggataaaaaggatgctaaaaagcactcttgaatacaggtttctaataactttaaattcgtatcatttagactcggtaagaatccctaaaactttaataaaaagactaactggtttataagactgctaaccaaagtagaacaaaaattaattaaataccaagaaaatactatgccagattttcatgctaaatcagcgtgaaaaatcagcatgctggagagctggcaaggtggctgaataggaacaggtctggtctgcagctcccagagagatcaacgcagaaggcgggttatttctgcatttccatctgaggtaccaagttcatcccattgggactggttggatagtgggtacagctcatggagggggggctgaagcagggtggggcatcgtctcacccaggaagcacaaggggctgggggatttccctttcctagtcaaaagaagccatgacagactgtacggggaggaacagtatactctggcccagatactgtgctttccccacggtcttcacaaccagcagatcaggagattccctccggtgcctggctcagtgggtcccacccccacagagcccagcaagctaagatccactggcttgattgggagaaaccagcacaaaaaagctgaaatttccaaaaaccagaatgcctcttcccctccaaaggatcacaactcctcgccagcaagggaacaaaactggatggagaatgagtttgatgaattgacagaagtagactttagaaggtgggtaataacaaactcctctgagttaaagcagcatgttctaacccaatgcaaggaagctaagaaccttgaaaaaaagacgaattgctaactagaataaccagggtagagaagaacataaatgacctgatggtgctgaaaaacacagcacaagaacttcgtgaagcatacacaagtatcaatagctgagtcaatcaagtggaagaaagaataccagagattgaagattaactcaatgaaataaagcaagaagacaagatcagagaaaaaagaatgaaaagaatcaaacaaagcctccaagaaatatgggaatatgtgaaaagaccaaatctatgtttgaacggtgtacctaaaagtgacaagaagaatggaaccaagttgtaaaacacatttcaggatattatccaggagaacttccccaacctagcaaaacaggccaaactttaaattcaggaaatatagagaacaccacaaagatattcctggagaacaggaaccctaagacacaactcatcagatacaccgacgttgaaatgaaggaaaaaatgttaagggcagccagagaaaaaggtctggttacctacaaagggaagcccatcagactaaaagcagatgtctcagcagaaaccccacaagccagaagacagtgggggtcaatgttcaacattcttaaaggaaagaattttcaacctagaatttcatatccagccaaactaagcttcataagcgaaggagaaataaaatcctttccagacaagcaaatgctgagagattctgtcaccaccaggcctgccttacaagagctcctgaaggaagcactaaacatggaaaggaaccagtaccagccactgcaaaaacataccaaattgtaaagaccattaacactatgaagaaaccgcatcaactaatgggcaaaataaccagctaacatcataatgacaagatcaaactcacagataacaatattaaccttaaatgtaaatggactaggctgggcacggtggctcatgcctgtaatcccagcactttgggaggccaaggtgggcggatcacctgaggtcaggagtttgagacctacctgaccaacatggagaaactccatctctactaaaaatacaaaattagccaggcatggtggcacatgcctgtaatcccagctactagggaggctgaggcaggagaatcccttgcacctgggaggcagaggttgcagggagccaagatcgtgccattgcactccagtctgggcaacaaaagtgaaactccatctcaaaaaaaaaaaaaaagtaaatgggctaaatgccccaattaaaagacacagactggcaaattggataaagaataagacccatcagtagtgctgtattcaggagacccatctcatgtgcaaaaacacacacaaaataaagggatgaaggaagatttaccaagaaaatggaaagaaaaaaaaaagcaggggttgcaatcctagtctctgataaaacagactttaaaccaacaaagatcaaaagagacaaagaagggcattacataatgataaaaggataaatgcaacaagaagagctaactatcctaaatatatatgcacccaatacagaagcatccagatttataaagtcagttcttagagacctacaaagagacttagactcccacacaataatagtgggagactttaacaccccactgtcaatattagacagatcagcgagacagaaaattaacaaggatatccaggacttgaactcagctctggaccaagtgggacctatagacatctacagaactgtccaccccaaatcaacagaatatacattcttctcaggactacatcacacatactctaaaattgatcacataattgtaagtaaaacactcctcagcaaatgcaaaagaatggaaatcataacaaactgtctctcagaccacagtgaaatcaaattagaactcaggattaagaaactcactcaaaactgcacaactacatggaaactgaacaatctgctcctgagtgactactgggtaaataacaaaatgaaggcagaaataaagatgttctttgaaaccaatgagaaaaaacacacaatgtaccagaatctctgggacacatttatagcagtgtgtagaaggaaatttatagcactaaatgcccacatcacaaagctggaaagatctaaaattgacaccctaacatcacaattaaaagaattagagaagcaagagcaaacaaattcaaaagctagcagaagacaagaagtaactaagatcagagaagcactgaaggagacagagacatgaaaaactcttcaaaaaaatcaatgaatccaggagctggttttttgaaaagatcaacaaaatagatagactgctagccagactaataaagaagaaaagagagaagaatcaaatagatgcaataaaaaatgataaaggagatatcaccaccaatcccacagaaatataaactatcatcagagaatactataaatacctctgtgcaaataaactagaaaatctagaagaaatggataaattcctggacacatacaccttcccaacactaaaccaggaagaagtgaaatccctgaatagaccaaaaaccagttctgaaattgaggcagtaattaatagcctaccaatcaaaaaaagtccaggaccagacggattcacagccacattctaccagaggtacaaagaggagctggtaccattccttctgaaactgttccaaacagtagaaaaagagggaatactccctaactcattttatgaggccagcatcattctgataccaaaacctggcagagacacaacaaaaaaaagaaaattttaggccaatatccctgataaacatcgatgtgaaaatcctcaataaaatactggcaaacggaatccagcagcacatcaaaaagcttatccaccacaatcaagctggctttattcctgggatgcaaggctggttcaacataggcaaatgaataaacgtaatccatcacataaacagaactaatgatgaaaaccacatgataacctgaatagatgcagaaaaggcctttgacaaaattcaacagcccttcatgctaaaaactctcaatgaactaggtattgatggaatgtatctcaaaataataagaactatttatgacaaacccacagacaatatcatactgaatggacaaaaactggaagcattccctttgaaaaccagcacaagacaaggatgctgtctctccgcactcctattcaacatagtattggaagttctggccagggcaatcaggcaagagaaagaaataaagggtattcaattaggaaaagaggatgtcaaattgtctctgcagatgacatgactgtatatttagaaaaccccatcatctcagcccaaaaactcctcacactgataagcaacttcagcaaactctcaggatacaaaattaatgtgcaaaaatcagaagcattcctatacgccaataacaggcaaacagtgagccaaatcatgagtgaactcccattcacaattgctacaaagagaataaaataactaggaatacaacttacaagggatgtgaaagacctcttcaaaaagaactacaaaccactgctcaaggaaataagagaggacacaaacaaatggaaaaacattccatgctcatgggtaggaagaatcaatatcatgaaaatggccatattgcccaaagtaatttatagattcaatgctatccccatcaagctaccattgactttcttcacagaattggaaaaaactactttaaatttcatatggaatcaaaaaagagcccacatagccaagacaattctaagcaaaaagaacaaacctggaggcatcacgctatctgacttcaaactatactacaaggttacagtaacaaaaacagcaggatactggtaccaaaacagatatatagaccaatggaacagaacagagacctcagaaataacaccacacatctacaaccatctgatctttgacaaacctgacaaaaacgagcaatagggaaaggattccctatttaataaattgtgttgggaaactggctagccatatgcataaggctgaaactggatcccttccttgcaccttatacaaaaattaactcaagatggattcaatacttaaacataagacctaataaccataaaaaacctagaagaatacctagataataccattcaggacataggcatgggcaaagagttcatgatgaaaacactaaaaacaatggcaacaaaagccaaaattgacaaatgggatctaattaaactaaagagcttctgcacagcaaaagaaactatcatcaaagtgaacaggcaacctagagtatgggagaaaatttttgcaatctacccatctgacaaagggctaatatccagaatctacaaggaacttaaacaaatttacaagaaaacaaacaaaccaacccatcaaaaagtgggtgaaggatatgaacagacacttctcaaaagaagacatttatgcggccaacaaacatatgaaaaaaagctcgtcatcactagtcattagagaaatgcaaatcaaaaccacaatgagataccatctcatgccagttagaatggagatcattaaaaagtcaggaaacaagagacgctggcaaggctgtggagaaataggaatgcttttacactgttggtgggagtgtaaatgagttcaaccattgtggaagacagtgtggcaattcctcaaggatctaggatcagaaataccatttgacccagcaatcccattgctgggtatatacccaaaggattataaatcattctactataaagacacatgcacatgtatgtttattgcagcactgttcacaatagcaaagatttggaaccaacccaaatgcacatcaaagatagattggataaagaaaatgtggcacacatacatcattgaatactatgcagccataaaaaaggatgagttcatgtcctttgcagggacatggatgaatctggaaaccgtcattctcagcaaactaacacaagaacagaaaaccaaacaccacatgttctcactcataagtgggagctgaacaatgagaacacacggacacaaggaggggaacatcacacattggggcctgtcaaggggtaggaggctgggggagggatagcattaggagaaattcctaatgtagatgacgggttgatgggtgcagcaaaccaccatggcacatgtatacctatgtaacgaacctgcatgttctgcacatgtatcccagaacttacagtataagaaaaaaaaagagaaatccgcatgctaaatcagccaatactaaaattgtttagatatacaatttgaataaactccatgatctaagccaaattacctatgataacccatcagttatcagtgctatgcacctaaattggagaaacaactggtattcaagaggacataagtccatttttaagcatggactcgtggagaaccaagacagccaccttatccttccagagtccttaaggctttcattattaaaagttctgcattttacgacttgtaatggaaaagataaaatgatccaaattaaatatgtttgtgtggtgacttataaactactaaaatagttataaacaatatttggcttgtcaaacccatattcctgggaaaacaatcaaagcttcaggtacatttggctacctgattggacatttaaatatttataagggatttcattcaattgtcactttcaatgcatgttttctggttgtatgaaagctttcccatgcaagaagactgatgttataatagtagattattatgctgcagtacatttttacatagttaaaaaaagctgtttatggttcactgaggacaatcaaccccttcacaatctagaacccaaagaatgaatcttctgagaacattagagaaagactgtccttgccatccacactacagcaaaactttgggaccttgaacttttggtttcagagatcccacaactttcataatctcacaactgaggagggtccctccacacccatcggaacccttaaggtaaagctaaccaggacagcttctcccaagaagacagcgtccttaatgtgaacagcttatcctaaaatcatggattaagacttctctactatcatgagactcttaactttgaatattttttttcttgcttatgcctctatgaacaatagaagtgaaaagggggtctgttatgtgtgtattatggggtatatgtttatttgtgaaggattttgcagccagccttatacatggataatgttatactttgatggataaaagatgaaggcccaatgcaggtgagaaattttaagggttcatatattgcctcatagtcagtcagaaacagaacattgattcattcctcttaagccacatcatgggctaaagagaacattgccaggaggccttcactcttctagcagggcatcatttgttaggtcttttttccatagtttgaagtaaaagaggcactgattagaaatgtatccctcatgataggttctatagcagattctactgtaaagcctatggttacacaaaaaactttaaattctcttgtgaaagttatgcgaaataatagaattggccaaaccgaaaagtattggctaaacagctgctggcacttatgatgtatggagaaaacatcgggtattatagtgattcagttgtaggggattaatgaaaaaaatcacttaagtgagtagactcttcatgtagctcattctttgatctatttgatttttagatggtttggtttggtttatgaggaccctgggtaaggaacataacccaaactcttagtattattctcccaatagtcctaatagtaatctccctggtatgctgtattctctcaaaggttttaaatgtttacaagcagccatctccagaatgtcaaatggtctctcttcaactggaataacaagagctaaaagaaatgtgtgaccatcaggacaccataacctatgaattacatgctgagaacagaaacccaaaatgatggtaactgagagtggcactgaggccctaggttttggtcacactgtcacctaagtgagaacctgaccaaaaagggggattttttttttaaaacgaaattatgggaggccattgttttggactgagctcatgcactagactccaacagaccaaaccaaaccaaaatggagttgttcatgctaaatgtgacaaagtcaaactaagactttaaggaaacacatagatcctagaacagaccaggttttgtttttctcctataaacaggatgttccagcataaggaggtaccttctactcagtccttgttgccaccttacagaacccactgttctactgtttcccagtgggtttaaagaccatataagtacatttacaatggtgatagtgacatcaatgactaaagttttggtcaatctctcaaaattgagaaaatcaccaaaaggggggaattattaaagcaaactaaatatgatctgagaaggactccatacttctatattcaagtccttgtggatgaactgtaacctagcctaataggcagacaagattgaaaacctaacttagtagtatgtgcccgtaacaatagctgagtcttggccaatcccagcagccatactccaaccactcatagactgctaagtgttcaaactgtgttcaaataaggcaaatgccaatccataacctatccagctgtttctgtacctcactgccaatttctatgtgtcacttttttttttgtctatacatttgctctgaccacaaggcaaccctggagtctttctgaatctgctgtaattctgggggctgcccaattcgcacattcattgctcaattaaactcctttaaatttaatttggctgaagtttttcttttaacacaaggcaatttgtgacttcaccactctcaagaatctaggcactgtaggtaaatttgaggcacaatggaaaacgccgtgtagtaaaggagagaaatgggctttgatatcagctgtgtttggactcagggcttactgttcagtgattctgggctgaggacttagcctctttaagcctcatttaagtcacctgtaaaataggccaggaagcttttctggcagggtcattttgaggattaaaggaaagacatttgtagagagtttggcatgggtaagtacttattaaacattgttctttttattttcctttatctgaataaaaatgttaacagatttttctagtaaacaactgaaatgactaaattttggtgatacatatacatgtagtctaaatcagaaaacagaaattctgcaaaaacctacccagttcggaatgatctgttaaatatcccaatcaaagaaagaattgacaacataacagcaaagacgatcattcccaataaaagtccaatgtctcctctgttgtctaatgaaaggaaagaaaaataattttaaccaagcattagtcttcatttgataccagaattactattctctttactctgctcaaagcaaaggtctcaaaggagaaagggtggggggaagcaaaattaacctttactttaggccacagagtgactgtttttccagagtgcacaactaccccaggaaacaactttttgtttgagaaagttgggctacatgtatctgatgtcagtgggtttttagaagtgcatctctggcaaatgtggtcggcttgtgcatgcaaatttcatataaattcttagtggtgagcttcatttggcttgtctgacacaggtgagaattcccaattgctgtaacaatgtctaaagctggttacaatcatactgattttttttaactttttgtgtgagatagaatgtgtgcaatttgtcatcattcttcaaaatctattgctcatgaaatttttcctgctgagaaaggacatccactttacttagagcaatatacgtgataagaaagaaatcatacactggcaagttaagataaaaataaaaaataaaaaagaaatcaaaattgcctttatgctgcactcacacttagttaaaaaacaatgctggctgggcacagtgactcacgcctataatcccagcactttgagaggccgaggtgggaggatcacttgagctcagaagtttgagaccaacctgggcaacaaagtgagaactccatctctacaaaaattacaaaaattagccgggtgtggtggcatgtgcctgtagtccccgctacttgggaggccaaggtaggaagatggcttgagcctgggaggtggaggttgcagtgagctgaggtcgtgccgctgcactccagcctgggcgacagagccagactgtgtctcaaaaacaaacaaacaaacaaacaaaaccaatgcttttcttgcatgtcaaagttgagttaatctcctaaaatatttaaataattaatataatttattcaacacatattacccaccaggctcatcatgctttctccctggtacatgaaaaagccctattttcaaatatagaagatagttgaggcattacttatcacattggaatttgttctagagccatgttgggtattggcttcccttccatcctccttcctcactccctcccttccttcagcaaatgtttattgggtacttaccatgtggcagacactgtgtttgccccaccctagttatttcacataccggggtctccaggctgcccagccctcttctaaagccaatcagcaggcaggagtctgagtaactctagctcactgcaaaatcttgatgggatatgaaattaatgttttcccagggctaaagagctatttctgactatttgaagcaactaattgggggtactggctgccacacacccttgggcattaattagtgcctggaagaggatagacagccctcaggtcaacacagtgctcggcaaaggggtctaagcagtagagcagaatgaccaagagcgtggcctgatatacctgggtttgaattaaactctgcctcttatcagctctgtgaccttggggcataattatgaacttgctgagtctcaggttttctcttttggaaaatagagataataatacttatctaacagagctgccatgagttcctaacctccactgatcccacagaaatatcaaggtgtaggtaggtctgtgtaggcatctataattagggaactgtactgaacctaagcacttggcttgcaattgattgataattcagagtgcccttacctttcttcatgtttctttttctttttcttctttttcctcttttttttttttttcctgagacagggtcttgctctgttgcccaggcgggaatgcagtggagctcactgcagcctctatctctggtgctcagttgatcctcccacctcagcctcccaagtagctgggactacaggtacatgacaccacacccatctaatttttgtattttttgtaaaaatggggttttgccatgttgtgcaggctggtctcaaactcctggactcaagcaatctgcctgccttggcctcccaaagtgctgggattacaaaatgtgagccaccatgcctacccacttcatgtttctttatgacacttcaccaccacctgacttttcttcttgttttgtttgctgtttttctgccctgtctggctagaatagaagctccatgaagacaggggctttgctcattgttttcactgctgattccccagtacccagaacagtgcctcgtacacaggagttgcttaatgaatattaaataaatgaaggtgcaaagaatagcaatacaacctgcaaaagttcttatactattcctgcctgatttctacacaaggagataaatggtctgtcagtggtcaatggtgaaatagtcatgcctaaaagttttcaactcgaaatttctatttagagttatgttcacccattgtacaaccagatctcaatttttttacgcctaaaacgtttaggcaagctcatcaatacgataatagtcatgctaacaactgaaatgggagctggtttgtataaaagaaagacaatagactccaggacattgaaagaaaaggatttgaattttagtctgtcacttagcagctctatgaccttgaaaagtttcctcaactactctaagtttcagtttcctcattataaaatagatgcgtaacacttatctcatgggttgttttaaagattgaagaagatgtctagacaagtcctagcacaagataggtaagtaatttgttttgaaagaagtttttgggtcttgagccctagcagctattaaaataaaaatgtggccaggtgcggtggctcacacctgtaatcccagcactttgggaggctgaggtgggtggatcacctgaggtcaggagttcaagaccagtctggctaacatggtgaaacccgtctctacaaaaatgcaaaaattagctgggcatgatggcggatgcctgtaatcccagctactcagaaggctgaggcagcagaatcgcttgaacctgggaggcggaggttgcagtgagccgagatcgcaccattgcactccagcctgggtgacagaacaaggcttcgtctcaaaaaataaaataaaataaataaaaattttaaaaaatgtatacaatctattgcaaaagccggcaaaatccacctaagccacttcttacattcagttttaagcagatctttgtactttgtctattattttcctatggaagacataaggcatatcttattgtccagaaacttaacacctgatgtgattttttcagtatgatgggttaaaatgggcaattactaaaagactactcaaaaagcctaagttgtattttcttaccagaagtaaggtgccctgtagagatggaagcaactgttagcccagaattccatgtgtcatgttggaatgcttttgatgtgacctggggaacttaaaccaaaaggaaagagtgtcagtttcttacattttgcactctgcttgccaaatttcccaacggagtttcttcccttgtttagagatgactaaagtaaaccaataactttaatgggcttgaagggtggaataaaagcaatagtcttcgagtatgtgtcttttcttcttctttttatttaattgggtaaatctcaaaggaggaaacactgcaagggcaactataatctacctaggttgtaaaacttcaaggtgtgtccactaatttcatgaggcttctaggcagcaaataccaaagagctttattttactgagccagaaaaaacgcatgataactaatctctatttgattccttgcaattgatggtgcaataaggttcagatttccttgagggtccccaagatgtgtcacttttgcctttgcacaatctttgggatgctgttcaccttctcctggctcctcataagaaacctaattttggttagcaggcactttggtgttgtaacacctgggtgggatgtcaccaatgacttctctctgctcttttcttttcctggcagcctggtctagttataaaggctgtcaggaaactgctaatgaatgattctgaccagggtggggtgagcaaccctggtacctaactttcagtctgaactcaaaggggtcctggtgcagccttgccagtctcctccttcctgataattaaaagctgacagaagtgacttcaaggacacaattctcccaactggcagaagacatttctgaagatggctctaagccttggatccctgagattgcttcaagccctgtgtattccgtcactctgatttcagtgctcaaatttttcttttaaaaaaattacttttgggggcagggagaaatcacaacttgaggctgagatatcacaggcttgtataaggagtagtgtggcccatgtgactgtctttgagaaaagtgtcctacatttccaatgaaaaggtttctacggggcttcagaaatttttgaaaaaggctggtctggccagacacagtggctcatgcctgtaatctcagcactttgggaagccaaggcaggtggatcacttgaggccaggagttgagaccagcctgggcaacatggtgaaaccctgtttctactaaaaatacaaaaattagccaggtatggtggtgcgtgcctgtaataccagctacttgggaggctgagacaggagaatcacttgaacccgggaggtggaggctgcagtgagtctagatcgtgccatagcactccggcctgggtgacagagggagactccatttcacaaaaaaaaaaaagaaaaaagaaaaaaggctgctctgggtgcaggcataagcgtgaggagggtagttttctgagaacagtgggtgagggattttagaagatgaaaacatcagaaaagccaaaagttatttcccgtgttttttgtcctggcttctctacagcaagaggaaaatgtttcacccggaattgtgacaaatcagaaattgtttttggcttctcaatgcctcgctaagtctcttttgctccatgggtatatggttccaccaaactctgagggaacaaggttatgccctgatggccaacagtcaggtttattcatctaaagtgctatctttacaggccaatgttcatttgcagggagctcaggcaggagtctgaatctccattattttgaaattttaagaataaaaatactggccagttgcagtggctcatgcctgtaatcccagcactttgggatgctgaggagggtgtcaggagttcaagatcagcctggccaatatggtgaaaccccatctctactaaaaatacaaaaattagccaggcatggtggcaggtgcctatagtcccagctactcgggaggctgaggcaggagaatcacttgaacccaggaggcagaggctgcagtgagctgagatcacaccactgcactccagcctgggcaacagaacaagactccatctcaaaaaaaaaaaaaaaaaaagagtaaaaatactacattaaaaggtaacacaattttcaatttagcaaaatcatgggcttatagcatatgctgctgtagtatttttgttttcacttttattattttaaaattagcatttttaatttaaaagtaatatatggtgttgttggcttttaatacaggttaatgtaattctgttgtataaactacaggtagttattggcaatgaaacttcattcagttattaatttgcatcatataaaaacaattttcatatctgactagggttttattagccctaacagggaataaatacaatcttcctttagagtctatttgttatcatagttccaaatcaaacaggtgcattaaattaaagtcacttataagaggtgcttaatcctcatagggaaatttcacaaggaatcagttatctaaaataagacaatttataaacaaaattgtcagagaagaaatcaagccaatgttagacataggactgaaacaaagctatgtagattacattcttcatggaatactgccaccacgtggctacgtcatttctttttaaattatacttaacatctttgactgtaaaagcgataattaaagtacagaaaaattttcaacaggagaaattaaaaggagaaaaaaagaaccatccctaatcccatccttttaatccacctgctattagtgctttatggtatttgcaagtattttaacatacaaaagcattagcaaacacagaatctcacacacacacacacacacacacacacacacacacacacacagcctttatgactggaaactgttttttatatcagttctgtcatcagtgcattgcctaatttgctaaaaaaaaaaaaaaacctcatgatatcttactgtatttggtgtttgtggtgttacgtccataatgagacagttccatccttgcaacagaatattaacttatgcctattaatctcacaggacatacttgaatatactaaaaaaaatccaaattatctttaatttgggaagaatttttatataacttgtacacactggcaccaaactttagtcttacaagaagacaatgtgcctgtgggaatttagagtgatctcaaacgagaaatatggtttcttattgttggacaaaatttaaagcataacaactatattttttggcctaccaaaacaccaggctagtttaatcaaatccactcaaaaggacctggttttagcaataacgtattccatctgtattttaaggatgatgccaaatcatcacctcagctcttctttctacatcaaccgtactagtctgttttcacactgctatgaagacataatcaaaaccggatttttttttttaagacagaatctccctctgttgcccaggctggagtgcagtggcatgatcctggctcactgcaacttctgcctcctgggttctagcaattctcctgtctcaacctcccaagtagctgggattacaggagcatgccaccacgcgtggcttttttttttttttttttttttttggaatttttagtagagacaggatttcaccatattggtcagactggtctcgaactcctgacctcaggtgatccacctgcttcagcctcccaaaatgctgggattacaggtgtgaggcaccgcacctggacaaaactgggaaatttataaagaagagaattttaattgactcacagttccacatgtctggggaggcctcaggaaacttataatcatggtgatcggggaaacaggcatgtcttacatgacaacaggccagataagtgccaagcaaagggggaaaagccccttataaaaccatcatatctcatgagaacttactatcacaagaacagcatgactgcaactgcccccaccattcaattacctcccgcgactcatggggattatgggaactacaattcaagatgagatttgggtggagacacagccaaaccatatcatcaaccatggggcaaagtgtgttttgtcatccttttaaagtgaccatttaatgagtattaattatgtcacaggtaacatgctaaactttacatgttttctctcatttaatcctcacaacaacccaatcacacagacaatattattatcctcattatacggataaggaaacaaaagagtagaaaggataaataacttgctcaaagtcacctaggtagagggtgaagagtggaaattcccatccagttctgacatgtagtttgtgctggtcactgatctcattaaattaataacctcacttccacagcaggatggctcagggtgggaggcagagtcagccctgcaagcagcctctcccaggatgagacttagcattgctccactgaggactcgccatggtgtgttggggctgcctggccttgtggggctctggaccccacaagccctactgtgctaacccatttagcactgatgctttaaatcttctagcgtagagttattttcttcttaaaaccgactactttcctttattacacaagtaatacatgctaattacaggatgcttgaaaagtatagaagggtatggagaagataatacaattttatatttgtttgcaaactagaaactattatttaaaaaaaatgttaacagtcttttgtgtatgttggtagcctagtggagatcatactctttataaatgttttgtcttgccttttttattcaatttttttcttttgagacagagtctcacaccatcacccaagctagagtgcagtggtgtgatcttggctcactgtaacctctgccccctgggctcaagctatcctccagcctcagcctcctgagtagctggaattacaggtgcacactaccacgcccagctaatttttgtacttttagtagagatgaggtcttgctgtgttggctaggctggtctgaaactcctgacctcaggtgatctgcctgcctcagcctcccaaagtgctagaattacaggtgtgagccaccacacccagccttattcaatattacttaataaaaatttcctcattttattaaaaattgttcaaaacatcatgctatggctagttaatgtttcatcatgttttactgtatttattcaatcttacccctattgagaaactgtatagctaggtggtttcaaacaccaactgcagactcaaacgaaactcagtccaagtcctggctctactagatggagttccatggccctgggcaaattgcttaacccctcagtgactcagtttcttcatttgtaaaattagataaaagcagtgaggtcatgaggtttgatgagacagttcatatcaagcacttagtaccatgttttacacaaataaaaccttaataagcactaattattgctattgttgaacttttagactggttccaaattcttactattataattaggttttggatgtatatcattgtacataaatttccttccactgattatttcttaaggccagatctctacaagaggaattactgagccaaagggtatagacatctctaaggtttctttatttacttttgcgcttgccaatcttgatgtcaaagccacagtaaccaaggcctgcatcataaaggctttgattagagcagacacatggacttttctggacctttcaggggttctagatattcaagaaagaggagtcatattaaaggagacaaaggatgtgtttttttttaaatcattggagattcgcccccaccctccctcctatttttctcaaaacacaaatacctccttttggtttctctctttcgcatctccttttaataattcagctgtttcacagcacttaagtgccatttctccaagccaggccagtttagctctgtggtcagaattcaacattatcgggccaagggtaaagagttgagtatgtcaattagcaaggcaaaactaatgccaacatatcaaataggcaccagaagcccagggcagggaaaacggtgtgtcagaacaaactcattaccacaccttgaaaaacaagtcaagcaatgaatcatttagtggattatagtatcagcggtgtatataagggtagcagggtacacacagacatattcaagggtttatcttccttcttatattcctgggctttaggtacttggtatgtagggagaaggtaagaaatctacatatggcagttacattgttaaaaagaaagaataagaggaggaaaaggcaaaaagcagtagccacccaggaaattttcctaaatgacaaggaccatacagagaaggtctgatgtcaaagtgtagcaaaactctatatgaaagaatggacagcttccaagtctacacagtggccaacagattcctcagaagtacacccttgctctccaggcatagcatcttccaatctgtatagtctagcagacatttgccatgttttatttgcccagcactaggatatacttctttgtgggcatcctaaaaaagctgagaggcagtagggctacaagcaaatggcctaaacctcaccaaccagatgccccctcccctaacacccaggctgtgaatgttgaagggttgacatagggcttccagaaaccacttagaatccaatgtgggcaccatagctgtatccagggtacagtgacagtggcaccagggcaggcagtggcagtgatcagcgtcagctgcagggtcctcgccagacttttcctaggctgtgattttggctgtggttctgggtcctgctctcactcggatcctgttcatgcccattttgccaggctttctactgattttcagctacctttctaataattctctttctgcttaagataaccagccttgatttattttgcttacacctaatcatcctgactagtaaaaactgcaattggtggtagtggttggggaggtagggagatgtagtaggacaaataatggcatcataaagatgtccgtgtcctaatccctggaatctgtgaacaggttactataatattacgaagtacatattgtgtcttcatcctggttttctggcatacaagtcctaaaatccttagaatgcccaaagtggtaacggtcattttgtatgctaacgagctgactagtggctggccgcccctatgtagtttcaggatgggggttgttcagaggaaagatcaaggcacgattagaaggttgggatttttcaacccatccccaacctcccagaggggagaggggatgaagattaagttgatcaccaatggccaatggtttaatcaatcatgcttatgtaatgaagcctacaaaaaaccccaaaggcctaagttctaggagcttcaggatagctgaacacatggaggttcctggcaggtgatgcacctggaaagcttatggaagctccatgcccctccccacatgccttgcccactgcatctcttccatctggctgttcgactgtatcctttgtaatgctgtttatcataaaccagtaatcataagtgttttcccaagttctgtggggcatcctagcaaattgatcaaatctgaaaaaaagatcaggaaacaaactctaatttatagccaatcagatggaagtataggtaaccacctattacttgagactggcatctgaggtgggagttgtaggatctgacactatgtctaggcagatagtgccagaatgaattgacttggaggacacacagctggtgtccctcaaagaatctgccagataatttgttgctgagggggagaaatccccatacacatgttggtaatcagaggtcacagaagtgacctgtgttgtgaaagtactatatagcaagagaaattgagtatgttctttctactcagttaccttataaggcaaaagggaattgagaggaagtggctatcctagattacatgggtggatctggtaaaatcacaagagttcttataagcagaagggagaaggttgagagtcagagaaagagattggaagatgctatgcttctggctttgaaaatgaaggatggagccatgagctgaggaatgtaggcagcctctagaatatagaaaaagcaatgaaactgattctgtcctgtagcctccagaaggaacataaccctattgacaccctgatttcagcccagtggttgtgattttggatttctcacctccagaactataagataataaattcatgttgttttaagctttcaagtttgtgatgatttgtgacagtagtaataggaaactaatatagaagatgatgacttcaagaaaaagcataatcataggccaggcatggtggctcctgcctgtaagcccagcactttgggaggccaaggtgggcagagttcttgagtccaggagttcaagaccaacttggcaaacatggtgaaaccctgtctctacaaaaaaaaaaaaaaaggaagaaaaaaaattagctgggtatggtggtgcatgcctgtagttccaggtacttgaaaggccaaggtgagaggattgtttgagcccagatcttatgagctgagatcacaccactgcactccagcctgggtgacagagagagaccctgtctaaaaaagaagggaggaaggaaggaaggaaggaaggaaggaaggaaggaaggaaggaaggaaggaaaaagaaagacagaaagaaagaaggaaagaaagaaagaaagatctttgttctgtagtaataggttgcaaacttcagggagattatggaactcttctgaattgtttcctattctgcagaaacttggtggtttatcagaggcaggacctgaagaaagttaaacccaaatgaaaagtctaaagtgattagaatttcaagaaacaccgtgtctgtttaacatgggttagtaaccaatagagtctacaagttcagaacccatctctatgtggacaattcacaaatctctaattacacataataaaatgtttgaaaaatacattctgtgtgccatcatctaatttgcattatatttaatagcactgatatttagttccgttaacataatatttgctttttcccttttagccacttaaaaacctgaaaaattaatgagcatcttcaaggagtcactggtagtgcaacaaccaatactgttttgtgagaggaaagcaaaatgttgtttaatatcttgctcatacttgccttcctctggaaaactgtcaaaaaaaaaaaaaaagagtaatatgagttctctgggaaacttttctatggcaagcagcaattcaagcaagtgaattagtcatcatgaaatgtgactgcccttcccttaagcctttaacctgttattaaaggaattatagaacctgtgtcttttcttcgttaaaaagggatctatattacaatgcagaattgaaaaagattcctggctagccattgttgtttcagcttttttaagtcagtagtagcaaatttagactactgacttatacattttcagtgttggttttctacaatgacaaattgtcttttcccctttggggctctttccgcactgctgaaagaccccaggataacagtgcctatcaaggttggtggatcagaagctctaacttcagcagctctcagcggttctcataatctcagctgaaacctcacatccagagacagggtgagttctaggcagaagagggtcatgtgtgatgtgatggttaattacgacaacagtcctatatcctgtgctttggggggttcctgtaatgcccaggtgggctggggtggtcagtgactcaggagaaataggaaacagagaggtgaccagatagtactagagataatggcctaagattctcacatgcccacccttttctgtcacccaaaccactactactaaggcgatggtgatacaaacagcaaacaggaaaatactgaataaatgagggtggttccctggcagaggtcccaccctcaagcttggaaacccatagccctaaatagaagcaggcattcttgttttcgtgctcaaaagttgccttttggcctgctatgccccgctatcctgtaccctcataaactccagaccccaggttccagaagcagacagagagataaatagaagagcagaagaatggcagaatggctcggcagagaaggacagaagaaaaggagcatctgaatgctgagagaagttcccctggggacgatcagagaggagatcggccgctggacagccaactccaggggaagatcatcctcccactctatcccccttccagctccctatctatcccgctaagagccacctccaccactcaataaaacccccacattcatccttcaaatctgtgtgtgacctgattcttcctggacactggacaaggacctgggtaccaagagggcactgagctggttaacagttaagctgtctgcagacagcaaagctaaaatagtgaactgtatcacattcccacttgggctttgggagtcacaggcatccacccctagatgctactgtggggctggagccccaaggtgctcaccccagctcctgcgcacctgtccatctgtgtgctccccctcctgtaacgggtttgagcatgtgccttggcagaatagatgagccacatgatatgcgacaggagtcagggaactctcccgtttcaatggcttgggcaatcatatccactctgcctttctgtccacattttctgtccattccctatgttgtcttttatgatgacacttccttctcttaaagagtgtgtctgacctctacagcaatggattttatgcttcactgcagaagtatcgcttggcaaagggctcaggaatctgtactttaagaagtgcccaagcattcaggccaggcacagtggctcgtgcttgtaatcccagcactctgggaggccaaggcagggggatcatttgaggtcaggagttcgagaccagcctggccaacatgacgaaaccctgtctctactaaaaatgcaaaaaaaaatagccaggtgtggtggatgtctgtagtcccagctacttgagaggctgaggcaggagaattgtttgaaccaggaggcggaggttgcagtgatctgagatggtgcactacactctagcctgggtgacagagcgagactgtatcaaaaaaaaaaaaagtgcccaagcattcttaatgtagattgtccacagaccctactatgagaaacagtgctttctagatagcccataattagctggtaaagcacatgatgaattgcccatgatggtcctgtcttggctaaggctgccttttttacctatcctttatcctcatctcagactgccccttccttacctatcctatcagaaacctcctatagtactatggtttcattctcatcatctactgcaaatctgcttccacatcttgtattcaagccaaagtagcagtagtcagtagtatcttctggttcttttctcatgcgtttgcatttccataacaaacactgcattagaaatgaagctctgttggcatagttttattactagctaatgtgtagagaatgattttgtttcacaggcggatgcaggaccctcctaggtctcttaggaaggagactagcagagctataaataacatgggtgctggaatcccatagcctgagttagaccctggctctactgtttaccagccttgtaatgtttgacaaaactgcttgggccatatggtttcatctgtgcaactgggataataattacactccttttatagagctgcagtgataaataaagaacaattcatatgtaaaatgcttatcaaaatgcccaacacttagtaagcatccaataaatgttagctattattatttattatcctgaagtcaccctgggattcagtctgttaattggcctcttgctattatatcagatagaataaatgggtattctggaggattgattttctttttcagtataaggctttgtttgtcctattaaagtctaaatactctaagtaagaaaaagagaataagtcattaaagttgattataagtgagttggtttggttcatttttgagaccaggtttttaatggccaagccaggcactattcagagggaaagcaacagaaaagaataagaatgccgaggctgcaggacaagccatacccacttcaggatttgtcctctggtcttagctgggcagaattttgcaaacacattgtattgagatgaatcaattcagtaatacacatgtcagaatcttagagactaattcagaaaagtcctgcttggaagaggcattactgcctgggctgtgtttcttcataaataaacctttaagcactggaaaagtttggctggccaaaaaacctcattatcaaacaagttggttaaataaataattacagaaatgatatcattttattttttcatttgtgaggcaattcatacttcagctgtgaagtctgattcttactgcttttatttacatctttatgtatgatgcaatgtaatttatgtaattattatgcttgatttttactgtgtgtcttctccagaaggaaacttgtccaaggcagggaattttgtctcctttgctcactgaggttctgcaaggatctaaaaatgcctggcacatggtagaggctaaatgagtattttgtgaatgactgtcttttcataggtccctttttaaaaagcaatcaatattaaagattcggtaaaaagcagttcgacaacatacatcagcatcttaaaaggtgcttaactcttgatgcaataattcttctttagaactaaaggaataaagaccatttatatacaaagctatgcaaagaagtttattgataatggataaaatggaaatgacctagatgttatttaggtagggaaatgcctaaataaattatagtacatacataaacgagaatgccgtgcagccatgaaatcagtttttaaaaacttaacagggtagattaagtaagaaaatcaggatataaaatagtatatacatcatagccccaaacattaaaaaaatgcataggaaaaactagtattaaattaaataaatgtaaatagtggatgtttttaggttgcatactacagtaaacttacattgcttttacacacagaaaaaaaggtacattttcaaagagatttaacatgagcactttccctaacacacttttactgtttctcatgtaatgtgtcttagaagggaatttgtaccaagagaacagtctatggtttctcttagctaacatgttaaactttaataaatccaagttttcagggatacttaattttaattggtatttttgtctcttaagtgatttttctcctcaggaaacagaccttaaatttaaactgtggtgttcctatttccttctacctgaagcttaagacttttatctttattttactttatttatttatttatttagagacagagtctcgctctgtcacccaggctggagtgcagtggcaggatcttggctcactgcaacctccgcctctcaagttcaagagattctcctgcctcagcctccctagtagctgggattacaggcacctgccaccacacccagttaatttttgtatttttagtagagacggggtttcaccatgttggccagggtggtcttaaactcctgaccttaggtgatccactcgccttggcctcttaaagtgctggggttacaggcatgagccaccacacctcgccaagacttttatgtttaaagaagaacatttgtagtcctatacttagaatacttaagtaagttgctcctctgcttccctgaaattaaagaatgaaattgctgagggatggtggggaaaatgcacagtattttcacactgggattaaaagtctcatactctaccaactgacctagccaagcagttcaatattttgaataagaaaagttttgttatagtttaggtgtcattacccaccagcaatgtactatttagtaagtcatgcccagtttccgcttttgtaaagtagcgctaattacactaccaaatatggctgacatcataatcaaacaagcttatacacaggagtacttcgtaaatgataaatggtagttatcaatttgcataatcttgctaggcagttatagagttcattaaaaaaaagggttatcaactaaattctgactattataaaatggcatctaaagtccacgaattgttaacagtatcaacttgacagaataccttcaattaaaaactaacttttaaaaaagagaactgatactgaaaataattccctggctgggtgccatggctcacgcctgtaatcccagcactttgggaggccaaagcgggcggatcacctgaggtcgtgagttcgagaccagcctgcccaccatggtgaaaccccgcctctattaaaaatacaaaaattagccaggcatagtggtgggtgcctgtaatcccagctactcggtaggctgaggcacaagaatctcttgaacccaggaggtggaggttgcagtgagccgagatcacaccactgtacctcaggctgggcaaaagagcaagagagcaagactgtcaaaaaaaaaaaaaaaaaaaaaaaaaaagaaagaaagaaagaaagagaaaaggattccctaataagttgtttcttcattttaacatttttaaatttaatttctatttatttttattttttttaaatagaagcagagtctcactatattgcccaggctgggtttgaactcctaggctcaagcaatccacctgcctccatttcccaatgtgctgggattacaggcatgagccactgcacctggccaaagtatttctaagatttgggcagtaggagataccagaagagctttgcagcaagtcatgctctttgctccctctactaatttggcagccatcaatatttataatgtatgtcaaagtgccttgaaaacataaaacacaattccagaatgttataataatgatgctattcatactgggattataataaagtccttcagttctgaaaagaaaatgttaaatctagtgtataaggtacctacagtagggagacatctttaggttaatggggccattaggagtattattacaattacaatagattcattttattatgtgcttcaactgaagtctatttggctaagatgttattgaatggcatgaataaatgaatataaaattaaactaataatattagaagcaggaaaatatctaaagataaacaataaatcagctaaatcctgttgaggagaagagaattctgtgtttaggagttttaactttctgattgctttacatatagtagataacgtttattgatatgattgttttgtgtctcttttaggagaatatgttcttaataaaattttctgagatggagtctcactctgtcacccaggctggagtgcagtggcgcgatctcggctcactccaacctctgtctcctgggttcaagccattttcctgcctcagactcctgaatagctgggattacaggcatgtaccgccatgcccagctaatttttgtattttcagtagagatgggattttgccacgttggccaggctggtctcaagctcctgggctcaagtgatccaactgcctccgcctctgaaagtgctgggattacaggcttgagccaccacacccagataatatttttcaaaacaagttcttagcttattgtatggctcacaattgcccaggatgtcacccaggctagagttcagtggcatgaacgtggctcactgcattctcgacctcccaggttcaagtgatcctcctgcctcagctagcatggtggaccgcatctgtagtctgagccacttgggaggctgaggcaggaggattgcttgagcccaggaggcagaggcttcagtgagctatgattgaagcctgtttagatcaataattcttcctgtagtccccaagtagctgggactatgggcgtgggccaccatgcctgggtaattttatttgtatttttggtagagatggggtctccctatcttgtccagtctggtcttgaactcctgggctcaagcaatctttctgccttggtctcccaaagtgctgggattacaggtgtaaaccagcgtacccagcctcccagatggtttttatacccaggaatgtttgagaaccattatataaattgtagtaagccttaagaaaatcaaagcaaaatgacaatttaaatgttatcatctgccctagaatagttttgtcaattttggtcaaaggtaaagagaaaaaaaatatcttgtagctttattttgtttttaacttatttattattattatttttatttttatttttttttgagaccaagtctctctctcttggccaggctggagtgcggtggtacaatctcagttcactgcaacctccacttcttgggttcaagcaattttcctgcctcagccttccgagtagctgagattacaggcacctgccaccatgcccagctaattttcgtatttttagtagagacagggtttcaccatgtcggccgaggaggtcttgaagtcctgacctaaggtaatccacccaccttggcctcccaaagtgctgggattacagacataagccactgcacctggctgttttaaactttttaggaaacagggtcttggtctttcctccaggctagagagcagtgggatgatcatagctcactgcagcatcaaactcccgggctcacgcaatcctactacctcagcttcccaagtagctgcgactacaaatgcattctaccacccaggctaataataattattatttttctgtacagactagggtctcactatgttgcccaggccagtctcaaactcctaggctcaagcaatcttcctgccttggcctctcaaagtgctggaattataggtgtgagccactgtgctcagcagaaaagatatataaagaaaagcccaacagaataaaatatataagtacactcacctgtttcaggtgttttatgaaaaaacggtgaactccaaggctgccagtaccttttgcctgtttcttgacatctcacttgaaatacgtacttaatgtttggctccaagtagaattctgactgttgcacatatgtaaaattggtgtcaaattctttaacctaaaatggatgggtaacaataataaaatgtggtgtgcttttaaaacaactattttatttagcagaaatgtatggaacacctattatgttccaagctgtcttctagactctaggaaaacaaagtgttctttatataaaacatggccgtacataatcaaatactgtctctgaaatacattaaaactgaaacacacactgctttttttgagatggagtctcgctctattgcccaggctggagtgcggtggctcgatctcagttcactgcaacctccgcctcccgggttcaagcgattcttctgcctcagcctcccaagtaactgggattacagtcatgcactacaacacctggctacttttttgtatttttagtaaagatggggtatcatcatgttggccaggctggtcttgaatttttgacctcaagtgatccgcccaccttggcctcccaaagtgctgggattacaggtgtgagccaccgtgcccagcccatactgctttatgtttgacaactgtctcaaatctccagaaagtccaaatgtgatattatatatatgtgtatatatatttatttatgtgtgtatatatatttatttatttatatgtgtgtgtgtgtatatatatattttttattttattttttttctagatagggtcccactctgttgcccaggctggactgtggagtgcagtggctcgatcacagctcactgcaacctccacctcctcctgggctgaagtgatcctcctgcctcagcctcccaagtagctgggactacaggcatgcactaccatgattggataatttttaaatttttctgtagagataagttctcattatattgcccaggctggtctcctgggcacaagtcatctctctgccttggcctcccaaagtgttgagattacaggagtgagccaccatacccagccttaattttggaatatattcttaattttggaatatattcttaattttggaatatactcttttaatggggtggagaaatggtagctgatagcaattgtctgaattcccctctcccctgcagctggatatttagatcaataattcttcctgaatgatgaaataattttactcgctaatggtgacttttagaaaaaaatacctataagctaagctgtaagttggtcctcattgcaggttattgcagattctacaaggcccaataatacatacatatatatatatatatatacacacacacacacacacacacacacatatgcatatatgtgtatatatgtatatatgtatatgtatgtatatatgtatatatatgtgtatgtgtcagagaaaaattaaaatattaagaaagttgaactgagaaatccaatggaggataaagaaaatagctgagggataaacacaaaaatccttttttccctggagcactacaccctgctataaaacgtaatgaaaaatgagccccaaacaagctgtttcagttggcagaaagaaaccaaggcatttgtacagcatcttcagtatgttctagtaactgatttactggaaaaagtgaagcatgattgaaaggcagacataaaatatgtcaatatgtctagaaatgcatttatgcaacaactaggtgaaagcagttatcagatactcatgaaagagaaagttacaacgattgagattaaaaaaaaaaaagaatgaggtatcaacctcattcagggatgcttccatttaaaacccaaccttaacattaatccttaaaacttgcaatgcactgaaaatgtaaaattcatgaaaatatttgtttgggggatgtcatctgccctagaatagttttgtctattgagacatggcttatggaaactctgaatgatatttttcaaactctgcatgaaagatatctttcagagtttccataagccatgtctctattcatggccctggaaattttctgcaatgttaatataactggagagtgtctgaggtctcctgggatctagagaaattttacttactgtgccaaagatttgactctcaaatgcactctgcttcatattagtgtctcttgtaaggaagttgttagtctccaatatgtttgctgccattacatttatagataagtcctcttaaaggaaagaaataccgtaaagtacagccagaattccaaaatagtaagaagaacgttatggaactgttatcagttgtttaaaccatgaggcaaaccaggtggctgcttagggccctgcaagtacaacatgatacctcaggatgatatctttggaggctaaaatgaacattgaaagagctggacttaattgagtgcctctgtaaatagtataatttcaagagtgcaagaaattttgaagtaagtccatttctacttagagcctcaactctgaaggttaggggtcattgaaacgtaatattcttcagtttgagatctctcttttcttatgttaaatataagttcctgggaacatccttgggtggagggaagaaaaaatctccaacctagttagagttctataattcctaccttccccaactatcagtatggggcatggcactggatgagagggtccttggtaacccaccagtgtctaaacccttggtttctccctttaccctacaacctcctcccctttctgcccaagtaatttttatctagtgtttggtagaggagggaaatggggtggtgatggggaaacttatttgtgactaatcatacatttttccacattttctgtcttataccaaccttcagacttggaaatgccgaagccaaggatttgtctttgctatctgtatgctgttctatcagccctttcaagaaaagaataaatacttggttttgtgcagcctaagttaagaatggttttctcacttttaaatggttgaaagaaattttttttaaaaaaagactatttcatgatgtatggaaattatgtgaaattcaaatttcagtgtccaaaaatgaaattttaattggaacagactatgcccattcatttacataattgtctgtgactgctttcacgctacaaacacagagttgagtagttgagacagaaatcttatgttctgcaaagcctaaaatgtttaccatttggcccttgaataaaaagtttgctgagaccctggtgtagcttaattagagaaatgagtcaccaataatccacttacttgaacacatagctgagatttccctgcctctgtcactaaagttggacaccattagacaaataataataataatagtaatagctaatgtttcaaaatattatccacatgaacttgacattataaaaatcaatggagatgcaaaaaatgatcatggcacatctctgccttccatgagttcacagttaaagagtagagaaatagaagtgtaaacaggcaagtatatacaatgtggcaaatgccctgaaacagagtatacggaagtaggtgtggattgccgttcgcaactgggagctcaatttttgacatgaatttgaggggcctaggagacagcccataaagatacaaacaaatagttagaaatataggtctgactttcatgagagttgggagggctccagtttctagcctacatacaggtgtagctgaggccttgggaataggtgaaaggagtaagaaagagaggagacagtgagatggtaggtatgaagggaatgtcaatgtttagggaattggcagaaaaaataatttacaaaggaaagggcatccagaaatattgatagaagactaacacattcttgaaatgggaaaaccaagaggagagacattttcaggacaaggtggtcaacagtgtcaaatgctagagtaggatgaagactgccaaggttcttggtctttattgtttggaaagatgctaccatcttcctctcctcacacgaactggttccagcagcaggtggagagccttgatgacattttgaggtggattgcaataatgcccaggtaatttcccagccctatatcctggccctttaccatgtagctttgaacgttctcccattctggctctggtttgtccatgtagcttgctttgagccaacagacattggtaagcctgatataagcagaggattgaaagacactggaaagattgggccttaggtactcttgccctctgccatcaccataaggacatgcccaggctagcctgttgatggcagaaagaggaccaggagacatgtagaggagagctcatgcaaagacataggagtgagccagctgagctgcaaacacatgcccaattccagcaaagctcaccttagaccagctggaccccactgacattgagaaataaatgtttattgttatatgtcccttcagcttttgtgacagtttgttacacattattgtgtagcaggacgagccgcagacaaaacctctcagacaccgagttatagaaggaagggctttattcagctgggagcatcggcaatctaccgccttaaaatccgagctccccgaatgcacaatttctgtccttttaaagggctcacaacactacagatttcacatgaaagggtcgtgattgatttgagcaagcaggcggtacgtgacagaggctgcatgcaccagtggtcagagagaaacaaaacagggcagggagtttcacaatgttcttctatacaatgtctggaatctatgaataacatcgctttctaagttatgagttgatttttaactactgggttttggccaggcaggcccagtcctggtttcgggcctggtgctgggttgcctgtctttgcttttacttccttgttgttttttcttaaaacaggtactgagtataaaaaaatataaaacaatatgagagggtctctctcttccctcaatcgtagcagtagatagccgatataccaatccctcttatttcatgtaaataggagtatgtaatagactagaaaaatgtttagaaaatagaaaggaattatattaccagtgtctctgaataagttttcagaaaccaactgttttctggttgaaactctcattctctgctccccctggtggtgctacataggccatcttggtaacaggtacatttgagctcacttttcaaaaccttctctttgtcagaagtggcaaatggaactgaaagaatatttgttatctcatatggtcttcataacaatcctttgtgacaggtagtattagctccattatataaatagggaaacagagtttgaaagaggtcaagccagatttttttgaacttataccatcagtaactgagtgcctctcacagactctacatcactttaaagaccacataaatatttagaaaatgaaaagacaggtctcaaaccaactttgaaaagctagttatattttgtaatcaagattacatagtaggtggtttttctctgagatgtttattttctttctttttatagagatgggggtctcactgtattgccccggctgcagtgcagtggctatccctggtgggatcatagtgcattacagcctcaaaaccctggctcaagtgatcttcctgcctcagtctctcaggtagctgaatataggcttgtatcacccctcccagctgagatttattttcttcttgctatctctgagcctttactaaaatctgtatatattccaacctggtctaagctagacttctagggaattcagaagggagagaggtaaatgaggtgggagcaagatgtttgtaaatgttctcccagaggcagctgtgtctccagagacaaaatctgaagctttgacctggaaccatctttcaagagataactagagtcatgtgtcacttaacgacagggatacattctgagaaatgcatcattaagcgatttcatcattgtacgaacatcatagattgtaattacacaaacctgggtggtatagcctactacacacctaggctatatggtatagcctgttgcttctaggctacaaacctataaagcatgttactgtactgaatcctgcaggcaattgtaatataaatcactaggtgacagaaatttttcagctgcatgataagtttatgggaccaccatcatatatgccatccatcattgcctgaaacatggactgctgcgtggcacatattctccttgcctcgtcagcctaattcccttagatacttcacagtctgtatgtaccttagctaaaggggctgaaaagcaccctcaatactgtgactttcagttggattcctttgctctactatccctgctgcatggctcccctagaggctagagagtaacattactagctagcatttagtgaacaattacgctattccaggcttgtagctaacttcttacatcattggatcccctttcccacaacaaacacatgatataagtgcttatcttatccccatgttatgtatgggaataacgaggcacagagaagataagaaacatgctcaagattgcatgactaggccgggcgcagtggctcgcacctgtaatctcagcattttgggaggccgagatgggcagatcacttgggatcagcctggccaacgtggtgaaaccccatctctactaaaaatacaaaaagaagccagacgtggtgcccgatgcctgtaatcccagctactagggaggctgagtcaggagaatcgcttgaacccgggaagcagaggttgcagtgagccaagatcacgccactgcactccagcctgggcaacacagtgagactctgtctaaaaagaaaaaaaaagaaaaagaaagattgcatgacttagccaggagcagtggctcgtgcctgtaataccagcactttgggaggctgaggcgggatggttgcttgagctcagcagttagagaccttgacactagcctgggcaacatgacacaaccctgtctctacagaaaaatttttaaaatttagctgggcatggtggcactctcctgtggtcagctacttgggagactgaggcaggaggattgcttgagtccaggaggtcaaggctgcagtgagctgagattgcgccactgcgctccagcctgggcagtagagcaagaccctgtctcaaaaggaaaaaaaaaaaaaagattgcatgactagaaagtagcagagccaggctttgaactctagagcctgtgctcttggccacaaggctttcctgtcgctttgaagtaaaccccccacctccagcaatatctaatggaggcaatgccaccacggagctaaagtggtagaagagacctgtaatctttggtatcctcccactcctcttgactctgactttcctgtcttcctacagacatgcagagacaacacttcatgcatgacccagatgaaattgacagtagcaaatgtaaacaaagcttcattctggctacagtgacttggcttgagtgatctggatagaaatggtaattcactttttctgtgttagtggttgtgtttaaaggaaacgtggtagattgactgagggagtcatgagtttaaaaaaactttctgaaaaaaataatggtggaggagacagaagctggctttggattgaaacctgtcttttcattttctaaatatttatttggtctttaaagtgatgtagagtctgtgagaggcacttagttactgacggtataagttcaaaaaaatctggcttgacttctttcaaactctatttccctatttatataatggagctaatactacctatcacaaaggattgttatgaagagcatatgagataacaaatattctttctactctatttgccacttctgataaagagaaggttttgaaaagtgagctcaaatgtacctgttaccaagatggcctatgtagcaccaccagggggagcagagaataagagtttcaaccagaaaacagttggcttctgaaaacttattcagagacactgataatataattcctttctattttctaaacactttttctagtctattacatactcctatttgcatgaagtaagaggatttggtatcctttttttttttttcctctggagacagagtcactctgtcacccaggctggagtgcagtggctccatcttggctcattgcaacctccacctcccagattcaagcgattctcttgcctcagccttctgagtagctgggattacaggcacacaccaccaggcttggctaaattttttgtattttcagtagagacggggttttgccatgatggccagtctggtcttcaatccctgagctcaggtgatccgcctgccttggcctcccaaagtgctgggattacaggcatgagccactgcacccagcctaagaaactcagtattctttaatatcattctatgactgtgatactatacaaggaccccaggtgtcttattaggataaaaccccattaattcagaatctaagacttgagaattgtatttgtgttgttttgaaatttaatctaaattctgcatatgcaaaaggaattcagcaggatcttcacttgattatcaatcaaatgatgcagaacgtggatcccatttaagtgtatgcaaacaaccataaagttcacatttatgatttgagtgaacaaaggtaaacaagttgacgtaaggaatttacttttaatgagtaatttttagggtatataataaaattagtatagttttgcccccatcttcttgatacttttaagatatattactctatagcaaaaccgatactcagaatcagtcttaaacagcaaaaggatttggaatcatgcttagcaccaaagaaaaattaagttatgtttaatgtattttagtgttaaatacatatcactttatttaacgctctgaaaactggtaatttcacagctgatacataactgttaattaagaaaagccaggccaggtgctgtggctcatgcttgtaatcctagcactttgggaggctgacgagaaagccagggggaggattatttgaggctagttcaagaccggcctgggcaacatggcaagaatctacaaaaaaataaaaataaaaataaattagccaggcatagtgatgagtgactgtagtcccagctacttgggaggctaaggcaggaggatcacttgagcccaagaggttgtggctgcagtgagctatgattgcaccactgaacttcagcctgggtgatgaagtgagagtctatctctaaaaaaaaaaccttaaaaaagtatcggaagggaaaaaaaaaggccagaaactatttcttaattatttggactaaatggcagtttgttacgcttaaaaataatcaaatagcatttcttttaaaatatatcaaaattggaacttcttcctaaatcaggctagtgttcctccacagctgaaattactgagttttattacgttgttcccaggtgctgttatctgatgtgactttattaatgaaccttgcagctatgcctttcttaagacactagataatttaaccttggcatttaaggatggttagtttgtttctctagacgttcacttttttaaactcatctttactcggattatcatcatctttaagctcacctaagactcaggcctatactggtaataaatattacactctgaactatacacttttcacttaaaacgaaacattcatacatcttagttctcctttccgaacaatttttgtttccctggatgcctgtcaaatttcagcacagaatacttaaattttttatccatgatcactgatataaatttcaccctaggagacactgaattacaaatagctaattagattcctcttagtcggagctttgtctatttagcaactaataaaaggcaagtggatcgtttgaggaaacagttctctgtttgcaagcatacaataatcattattaaagctagagtggttttcctaagtgaattaacacaggaacagaaaatcaaataccacatgttctcacttatgagtgggagctaaacactgggtactgcattagtctgttttcatgctgttgataaagacacactggagactgggaagaaaaagaggtttaattggacttatagctccatatggctggagaggcctcagaatgatgatgggtggtgaaaggcactacttaacatggcagcagcaagagaaaatgaggaaaaagcaaaagcggaaacccctgataaatgcatcagatctcatgagacttattcactatcatgagaatagtatgggaaagacgggctcccaggattcaattacctcccctggctccctcccacaacatgtgggaattctgggagatacaattcaagttgagatttgatgggggcacagcaaaaccatgtcattccatccctggcccctccaaattcgtgtcctcacatttcaaaaccaactatgccttcccaattgtcccccaaagtcataactcatttcagcattaacccaaaagtccacagtccaaagtctcatctgagacaaggcaagtcccttccacctatgagcctataaaatcaaaagcaagttagttacttcctagatacaatgagggtacaggtattaggtaatacagccattccaaatgggagaaattggccaaaacaaaggggttacagcgcccatgcaagtccaaaatccagcagggcaactttaaagctcccaaatgatcttcttttattccatgtctctcatccaggttatgctgataaaagaggtgggttcccatggtcttgggcagctccaaccctgtgactttgcagggtacagtctccctcccagctgctttcatgggctggtattgagtgtctgcaacttttccaggtgcacggttcaagctgttggtggatctaccattctggaatctggaggatggtggccctcttctcacagctccactaggcaatgccccactagggactctgtgtggaggctcagaccccacattttgcttccacactgccctaccagaggttctccatgagggccccgtccctgcagcaaactttcacctggccatccaggcatttccatacatcttctgaaatctaggtggaggttcccaaacctcaattctgacttctgtgtacccgcaggctcaacaccatgtggaagctgtcaaagcttggggcttccaccttctgaagccacagcccaagctggatgttggccctttgagccatggttggagcagctgggacacagggcaccaagtccctaagctgcacacagcacagtgaccctggtcccagcccatgaaaccacttttttctcctgggcctccaagcccgtgatgggaggggctgctgtaaaggtctctgatgtggcctggagacattttccccatggtctagggaattaacattaggctccttgctacttgtgcaaacttctgcagctggcttgaatttctcccccccagaatgggtttttcttttctattgcatagtcaggccacaaattttctgaacttttatgttctgtttcccttttaaaactgaatgcctttaatagtacccaaatcaccacttgaatgctttgctgcgtagaaatttcttctaccagacaccctaaatcatctttcgagttcaaagttccacagatctctagggcaggggcaaaatgctgccagtctctttgctaaaacataacaagagtcacctttcctccagttcctaacaagttcctcatctccatctgagaccaccccagcctagattttattgtccatattgctatcagcattttgggcaaagccattcaacaagtctccaggaagttccaaatttcccacattttcctgtcttcttctgagcccttcaaactgttccaatttctgcctattacccagttccaaagttgcttccacattttcgggtatcttttaagcaatgccccactctactggtaccaatttactgtattaatccattttcatgctaatgataaagacatacccaagactaggaagaaaaagaggtttaattggacttacagttccacatggctggtaaggcctcagaatcatggtgggaggcaaaaggctcttcttacttagtggtggcaagagaaaatgaggaagaagcaaaagcggaaacctctgataaacgcatcagatctcgtgagacttattcactatcacgagactagtgtgggaaagactggcctccatgattcaattacctccccctgggtccctcccacaacacctgggaattctgggagacacaattcaagttgcgatttggtggggatacagccaaaccatatcaggtactcatggacataaagatggcaataatagacactggggaccacactagagtgtggaggaaggtaggaaggcaagggttgaaaagcaaattattggtaactatgcttagcacctgggtgacaggatcaatcataccccaaacctcaataccatgcaatatatccaggtaacaaacctgcacatgtgcccccgaatctaaaataaaagttgaaattataaaacaaaaactaaagtggcttgaatatcatgcaaacaatcagattaaaaacatgtaaaatagacataataagtccactgtagccactgatggttggcttttaaatcattcattcacatgctaaagcataatgaaagttgagcttacattccaagtttggtttgttgtagccttgtatctcatttcacaggaaaccttttcaattgttgtttgactatcccaataaattatggtcttgggcactgtagcatttatagtctcagccctggaaatgacggctgcagaaggtatcactagaaaaaaaaaaaaaaaaaaaaagacctggctgtttaaaacttgcctagggagaaactggcatcttttcgtcaatatctagatatgagaaagctcaaagtaaaaaaaaataaaattcatggtctaatgaacaattatggacattttcttatttgctaatttgttacatagaagaaaactgctgttaaggaaaattctattcagcccattccccattaaaaaaaaaaaaactgaactctaatagtcctgtctttcccccacctttcactcccttacaatcctaactaataaaattccagagcctagccttgttaacaaaagagtataaaaatgagataaaggagctatcccctcttccctccatctgttcgaggagagatgatatgcacccaaatttagttcagatgatcagatttgaaaagatgttaaattgagccaggtgtggtgatgtgtgcctgaaattccaactactcaggaggctgagatgggagggtcacttgagcccaggagttcaaggttgcagtgagccatgatggtgcaactgtactccaccctggacgacagaatgagagcttgtctcaaaaaaaagaaagaaaggctgggcatggtggctcatgtctgtattcccagcatttgggaggccgaggtgggcagatcacttaaggtcaggagtttgagaccagcctggtcgtcgtggcaaaaccctgtctctactaaaaacagaaaaaattagcccggcgtggtggtggtgcgtgccaatcccagctactcaggaggctgaggcaggaggatcgcttgaacccgggaggcagaggttacagtgagctgagatcatgccactgcactccagcctgggtggcggagcgagactctgtcaaaaaagaaagaaaggaagggaaaggaggaaggaaaagagaaagaaaggaagagacagaaagagcaagaaagaaagaaagaaaaaaaaagagaaagaaagaaagaaaaagaaagaaagaaagaaagaaagaaagaaagaaagaaagaaagaaagatggatgttcaattcagatcttttatcacaataatcttctccttctcttgtgtattagggaaacatatgaatatttatatctattgctaacttgttttgttctcctttaaaataaatctgtccttccttgaaattttatttgaagaaagcagatctcataagactctaaggctttgtaaattgttggcatgttctataataataaccttcacagaaggaactgaaattctgattggttattttattagttgttttgttatagtaggaggtatatagttggaatcgctatgtttctaaactgtgtaaatacttgtaagtttgttttgtctgaacagaatagaatcattaacactttccatttctcccctaaggaacaatgaaaacctatgactttgatagctgtactatttaacaaagaactcaagggcctgtaggcgtggttttagagaccactattacaggttaatattctctatgaattagtttattttcatttattctaggtttataaaactttctttaagaaaattattgttttactacaatgactattatactattattatctaaaattatgtgcaaaggtagatgatttacagagaaaaacaaaaattaaggatttgctgtctagtaacacagtcctctaataaaattttgggggctacacctggcgtagaagtagcagtagctttaatttagttaacaagtttactgtactcaacctttatcatctgaattccatagctgatttccttttgctagtgcaagcttcttgtaataagaatcagtattcaggctggacacagtggctcacacctgtaatcccaacactttggggaggcctaggtgggcagatcatttgaggtcaggagttcaagaccagcctggccaacatagcgaaacacctgtctctactaaaaatacaaaacttagccaggtgttgtggcagacgcctgtaatcccagctacttgggaggctgaagcacaagaatcacttgaatccaagaagtagaggttgcagtgagctgagatcatgccactgcactccagcctgggtaacagagcaagactctgcccaaccccaaccctggaaaaaaaaaaaaaaatcagtattgagattctagagtcaagggcgtggatccctggggctctgaaattgcttaggaccattttaagcaccctcaaggccataaatttctcacctcctcctgtcacccacctccacctctgagttcggcttggccactgttatagcagcacaagcattctaggacccttttggcaaaagaattattctgaggagaaagtaaaaatctgtttagtcttatgagaaatgcagatagcacagtaagaatcacagcataaagcaggtcagtgcaatccagatttaagtctttaagtttgaatgagttcatatttttgcaaactggcatttattatgtaatacatacttgaatatttagtttgttacacaagactcagatgttgaatttttattcttactgattaggtttcacatatttccaccagatcttacattttaaaaaagtatcgggaggtcgaggcgggccgatcatgaggtcaggagatcgagaccatcctggctaacatggtgaaaccccatctctactaaaaatacaaaaaattagcggggcgaggtggctggcgcctgtagtcccagctactcgggaggctgaggcaggagaatggcgtgaacccggaaggcggagcttgcagtgagccgagatcgcgccactgcactccagcctgggcgacagagcgagactccgtctcaaaaaaagaaaaaaaaagtatcaattttattatagatgtcatatttttaaattctactcgtattgaaataaaagcgagattatagccttttagcatctttccaacacatatttatccatatttatataatggggagaagtaatattcaaaatggcaggcagaaagcacagcaatttctgtacccgaatttatttccctacaagagaagttaaaagcattcctctcatatgcttttttggcaagtgttaatgtgctactaactctgcgctgccattcagcataacctccctaatgtcattaaagcccagcccgtagctgctatgtggaaattgttcccaggacagtcttctgttctcagtggcatagaacagttcatttatctaatttgcgttgtctcattcttaaagtgttacccatgaagacggctcatctgttaataatctggtggttttgttggctggggcctcctatacaattaatccatatttttcaacctgagtttctgagtacattctgggataatgaaaaggcaaggaaaggaatagagacaaaaggggaggaagaggtggaggaggaggaggtggaggaagaggaggagggaaagagaaagaaggagaagaaggaaaaggaaccacaactccaaactcctagttcccagtgtgagaagtcagtctggaagtagaggccagatgggattttttcctttgtgggaggtgggatggtggtaaactatagcaagtcagcatgtctgggatgaaatctggctttcctcattactagctaagtgactttgcgcaaatcattttatcactttcttcatctgtaaaatggggacagtagtatcatgtatggttgtttccagaatgaaacgtgatgtgcatgagaggtgtctggaacacagaaggtgctaaataaattgatgcaatgatattaagatcagaatggtaataataatacaagtattattattattatttagttcctaaaaattgcactgctaaaatgatactggtcatgatagctcttaaacatcattaatttatctatcgtaagaaaagggtatattactgcattctacctcaaaatgtaaattcacaaaaatgtatagagcatagtcaagagaactgtaactccaaggatatacaataaaatggaataattgtccatcatcatattcaacagagtgtgttttcaaatctaatattcaggccggtcatggtggctcacgcctgaaataccagcattttgtgaggccaaggcaggaggatcgcttgagccacagagttcgagacaagtttgggcaacaaaatgagactctgtctctaaaagagatttaaaaaaattagccaggcactgtggcctgtggcctgtcgtcccagctactcgagaggctaaggcaggaggatcccctgaattaaatgttccctacctctgtgatctcaaattttttaatgccatcaaacctcagttttctaatatataaattataatctcatctacaaaatagggttgatatgagggttaaataacgtatgtgaaaagctgttagctggcagtggctcacgcctgtaatcctaacactttgggaggctgaggtgggaggattgcctgaactcaggagtttgagaccagcctggccaacatagcaaaatcccatctctactaaaaatacaaaaatctatatagccatgaacaactttgtggcaatatagatcagctgggcatggtggcacacacctgtagtcccagttactagggaggctgaggcatgagaattgcttgaagccaggaggcagaggatgcagtgagccgagattgtgcaactgcactccagcctgggccacagagtgagactctgcctcaaaaaaagaaaaagtagttagcacataagaaagtgctcaataaatgttagcttattgaaatatctttaattataacaacaggaatcattggtactgggatctgcaaagacaggatgattcagacttggtgtcatttggctgaattgtggttttaggacttggatgtagttgtaaaaggctcaagggtaattactttttggaatttatcttaaggaaacaatcaaaaactatgctaaaattcagccacaaagttgttcatggcaatatagtttatatggttaaaaactgaaaacagtgttaatctccaacaatagggattaaactgctatatattcagacaacattaaaaataaaactatagattaaattaatagaaatgtttattactaatatataagtataaaaaggcagggtataaaatatctgaaacaaaaactattaatgtttgttaaatctggctgatgaacatagagaggtctacataattctctgcaattttctatgtattttgtaaaacttttcaaaataaaaacaaacaaacaaaaaaaccttacataagtccccaagtagtgtatagagtataagaatttagcatgctgtacttttcacaacgtaagactcaacaaactttatcatgatcatagtgtttttttgttttttttttttttgccttccctagtagattgtaagttatttcagggcaggcaccttgtctatcttattcactctagcctttagaacaatgcttgaaaataagaagtttccaataaatatttgtaaaaacacatatatggatttttttttttttttttagacaagagttttgctgtgtcacccaggctggagtgcagtggcacaatcttggctcactgcaacctctgcctcccagattcaagcaattctcctgcctcagcctcctgagtagctgggactacaggtgcccgccaccatgcctggctaattttttttttgtacttttagtagagacagggtttcaccatgttaaccaggctggtctcgaaatcctgacctcaagtgatcgcccacctcgacctcccaaaatgctgggattacaggcgtgagccaccgggcccagccacatacaacaatttagaaataagactggaaggatatacaacaaaatggcagcagcactactcatctctaagttgtcttgggcaggtagaattatgggtaatttctgtttcttttatcatgctctgcaggaactttaggggaacttctttcagatctagacctcatttgacaaggtcagcacaaactggttattattaaagacttacagaatttcttattctttacctatatcatccaggtgaatttgcagttgttttgactcttccatgcctagtgcgtttgctgcttggacccaaaccaagtacttcttgccaccttgtaatgaatcagtggagatgttaatatagcttgaggtgagatactgttgctcttcttctgtctctaaacttaaaacaaaaaaaaaagatgatcataaattgtatttagtttgaattaattggccaggcatggtggctcacacctgtaatcctagcattttgggagaccaagcgggttggatcacctgaggtcaggagttcgagaccagcctggccaacatggtgaaaccctgtctctattaaaaaaatacaataattggtggcatgtgcctgtaatcccagttacttgggaggctgcgaaaggagaattgctggaacccgggaggcagagcctgcagtgagccaaggtcacgccattcactccagcctgggcaacagagtgagactctgtctcaaaaaaaaaaaaaagaaaaaaagtttgaattaattattccagatttttaaaatgttacctttttaaaaaaaattagaatttatggctcacgcttgtaatcccagcactttgggaggccgaggcgggcggatcacaaggtcaggagatcgagactatcctggctaacatggtgaaaccctgtctctaccaaaaatacaaaaagaaattagccgggcgtggtggcaggtgcctgtagtcccagctactggggaggctgaggcaggagaatggcgtgaacccaggaggaggagcttgcagtgagccgagatcacaccactgcactccagcaggggcgacagagcgagactccgtctcaaaaacaaaaacaaaaacaaaaaattaaaatttaattttctaaacagtagagacagggtcttgctgtgttgctcaggctggtctcaaactcctggactcaagcaatccgtgcatttcagccttctaaagtgctaggattacaggcatgagccactgtgcctggacaaaaacgctaactttttaagcctgctttcaaatatgcaaccttttactgaaaaatatttcaaaattgattttattttcacaattttaaaaaataaattcaaatctgacaagggccacagtatgatttcaatgggccctgaacacttctgccttcatggaccctttcctccattaaaaaaacaatgagcgtatatattatataaatatataaaatacacaaaaatatacacacatatacatagatgtatacatatgcatgccatatacatgcatatacatgaacataacagttatttttctcttctgattttaagtaaaattaaacattttcatggactcctaaaattattgtgggccctagccactgtgcctactgtgcctgttagggaagtcggcactggacatagcttggaatagccagaatagctgcctttggaaaagagcactgcattttggttcagtgcaaggactgtgaagtcagacatttctatcaggacatagggtgaggatggagtggtggggaggagtcaggatggggtgagagatcgcaatggggtagggggaaggccaacctcctggacagagacaaccagcatgttctgaaacaaatacgtgaaataacatgacatttctgagaaggttcaacaagtgcaatagcctggatcctgaaaatgcaagaagaaacttgtagtggagcaggcctgtcagaagaccttccatgagctactgatggatcaggactgtatcatgtaagtgatagaaagtgagtgcatatagtgagattcacactattttgagggtctctgggactgtctagcacctttacggaggatttgtgggaaatgaaagtggtggtagtggaaaaatcaaaaggctatacaataatccagaattggattattagtctgaaataggtggaagccaatgggggtggatatgaaggattttgagacagggtctggctctgtcacccaggctggcgtgcagtggggccatcttggctcactgcaaccttgacctcctgggctcgagtgatcctcccaccccagcctcctgagtagccgggaccacaggcacgtactaccatgcccaattaatttttgtattttgtgtagacatggggttttcccatgatacccaggctagtctccaactcttgaactcaagcactctgcccgtcttggcctcccaaagtgctgggattataggcatgagccacctcgcccaacccatgaaggattttgagtgtagaactgactggacctaatgacaggtttgatgaggggaaagggagtcatgcactgtggaagaggatggaaaagataaagaggaaagatctagtttagaacaggggaatagagagggctattaagtatcatttcaaagcatatttatctaagtatttataattgaatgagaatatccaagtagcccaataaacttggtagaattccgaatgatatctgttaatgccagagtttcaaattgttttcactggctttggacagaatgtttgagcctctgtttttaaatctctacccctaaataatcacatgatgtttttagtggacgagggttggaggcggtggcgaaaggagtgctggagaatgcttctttgctcctctgatttctgtgaagagatttgatattgtttccaccctcatcctctccaaatctcatgttgcaaagtcatcaccagtgttggaggtgaggacttgtggggcagacccttcatgaatggcttgctgccctcctggcagtaatgagtgacttctccctctgagttcaggcagatctggtcattttaaagagtgtggcatatcccccctccctctatcttgttcacaatcttcctggacagcctgcagaactgtgagctgaaataaaactcttttcttcataaattaccgagcctcaggtatttcttttcttttcttttcttttcttttcttttttaatgacagggtctcactctgtcacccaggctggagtgcagtggtatggccacagctcactgcagtcttgacctcccaggctcaggaggtcctcccatctcagcctcctgagtagctgggactacaggcatgcaccaccactctcagctaattttttgtagagacagggttttgccacattgcccaggccagcctcgagctctgagctcaagtgatcctcttgccttggcctcccaaagttcagggattacaggtgtgagccaccacacctggtctagatatttctttatagcaaggcaagaatggactaacacaggagtgtcctcaaatctcctagcctcttgtcccaccccttgttcactcattcttctgcagagatgaatagggcccccctcagactccaaaacacaacataatctgtaatcagattcatttgtaacatggaagtattttcactagaatttcctcagttcccatttcttgagccccttgaactacctactccattatttcatgttcttaagcttctcagattttctacctccttagtaactacatccaacttattcccatttggtctttagtccttttattgtgatctttgcctttacttttccttgaaactgctcttttaaaatggtgtcctttacaaggtgaagtcctctgaatcctcatttaagcatttatccctcttgattggttataattctcacttccttgctacccaaagcctgtcttctgggttagagggccttcctctctcacacctacttagtggcatgtccccctccagccttccacctgggtttctttccctactctctgagttcactcacattgaaggtcagccctggtgtttgccttttccctgacccctttttctgggctcactcccttctcagcttcacctgctatttcacatgtgtgtctcacgcatacctgtgccctcactgggagcttcatttggatgtctgactggaaccagaactatagaaaactgacaactaaattatctttccatgcaaatcagcacttcttgccagtgtcttcattgttgtcaaaggcatgcggtccacctttctcagtttgccatttttaacaattttctcttcgtcacctttaagagccaaccaattactaaagaaggttaagcatttttttaagcattaaaatattattttcctatgttatcttttttccctgttttgatagctatggcaatggtctaggtctttgttacctgtttggtttatgactttcagactcctaagttaattgcattacatcatgaaacttaacttgatatagatatactactttagaaggaaagtaaccttgaaatctgaacaatgctggaaagccaagtagcctacattcttattttcttctattttttagagacagggtctcactctgtcacccaggtttgagtgcagtggcacaaatcataactcactgcagccttgactttctgggctcaagtgatcctcccacctcagcctcctgagtagctgggatcgcaggcatgtgccaccaggcctaactaatttttttatttaaaataatttttttttaagagatgcagcctcgctatgttgcccaggctgttctcaaattcttggcctcaagggatcctcccacgtgaggattacaagcatgagccaccgtgctcagccatatacattcttatttgtatcaaatggaaatacttcacaaatttgcatgccgtccttgatcaggggtcatgccatcttctttgtcttgttccaattacactgtttgtgctgttgaggcagactctaacctgattttttaaatctaataccatcaactgccctctctctcaggggactgccttgattggatttgtggagaagataaagcttaaaaatcactgtccctccaccaaggctccaccaagtcctgttactactatatatcttttcagcaactcctaaatttttctagccccaaaatatcccaccaggattaaacttgctagccacttacatcttttggaatccaagaaacgtgcttgctgagacgcagagaaaaggaaccagccttatgctattaataccaagcaataagcagatgtgtgcatctaagtactatagaaattctatattttatataatttatataaacttattgctactatcagaacaagacaacctcagcaagtggtcaaggaatctctctaaggctgatagtcattggaggggtgaggagcaactcctcctattcagctcaggtttttcggttccagtgcattttttctgtgttacctctttcctcataccagcgtgagatcactatgaacaccatgagaggacgaggagggtatgtcatggtgactaaaatcacagggcttgggttttagagacagacctaccttcaaatcccagctctgccccttgataagttgtaagacttggagcaagttacttaagctctatacagctcagtttactcatcctcagtataggaatgataacgttgttgttatcatgagtaaattaaataagaaacagagtagatggcttctcacctaatgaaggactcattaaacaacaatttttctgaattaagagatactggctgaggccaggcatggtggctcacacctgtaatcccagcactttgggaggctgaggcaggcagatcacttgaggtcaggagtttgagactagcctggccaacgtggtgaaaccctgtctctactaaaaatacaaaaattagccaggtgtggtggcaggcacctgtcctcccagctactcaggaagctgaggattgcctgagcccaggagatggaggctgcagtgagccaacattgcaccactgcactccagcctggatgacagagtgagactatgtgtccatttaaataaaaaaagaagatatttatgatatgtgactttgacacattctaaagaatacaaatgaaacttttaaaattgctatatttcttaccagtaaaatttctcttatatcactgtatcttaagttaaattatgccgttaaattgagatgtttacatagttaccttatattctttctgaaataagatgaaacgtaaataccttaacagagaacttgttaaagtatgttaacctcatgctaagtaagaattcaaatgtgaaaacaagaaaatggcaactatgtgtaaatggtaagtaggacatctttgaatattttccagttagagaaaaccacattatatgttcttcattggtttgtggctaattcttttaccacacatactgagaccacaagtcaaaatggaaatgtattttcaaactgacagtaaccatagttactaagtaatttaattctgcttttaaagtctaccccatattagcacctagaccacaaagcactgttttaattgaagaatctgataataatgactaattacaccttagggttatttttatatagaacttgtgatattgtgacataataagaaatatatatttggtttctgtctggttcccagcacacagctcctaaaacccttggaatctccaaagtgctaatgagatggctgatggctgggggctcctggataggcttagggtaggggctggttgccaggggaaccaacaatgtgatgagaagattgaaactttcagtccccccaacccccttgccctttacccacccccatctcctgggaagagagaagggctgaatgatccccaatggccaatgatatgatgaatcgtgcttatgtaatgaagcctccataagaacccaaaaggactgggttcagggagcttccagatatctgaacatatgaggatgcctgcagggtggtgttcccgcatgctttgccccatgcatctcttccatctggctgttcatctgtagcctttgttatattctttataataaatggataaatataagtaaagtgtcttcctgagttctatgagacactctagcaagttaatcaaacctgaggagtgtatcgtggaaaccacaatttttagccggttggtcaaaagcacaggtcatgacctggggcttgtgattgacatttaaaacagggttgagtcttgtgggactgagcctttagctgtgggatctgatgctacctccaggtagacagagtcagaattgaattaaattagaggacatctagctgatgtctgcaggagaattgattggtgtgtggggaaaatcttcccacatttcgtgtcaggagtgctgttgagagtagaaaggagaacaacactttggtttttcctctatcttttacataactgtatattacaaagtttttgaatatcttatttctatttctttttttcatgggctaatacatgacagatgatttgtgaagggagttagtataattcatatttttctgatgttccctgagcacctagatatagttgtaatttatagattttcaaaaaacattgcagatttatgttgataatggtaaatagtgtctttcattcatttaatcactcattcaataaatatttatttaacactgactatattccaagtatatttttagatattggggctacaatgaacaaaacagataaagtcccaactgtcatgaagcacacattttggtggaaacaaataaatatagaatctgatctatgtatggtgagaaatgttcagaagaaaactaaagcggagtaaaaaggttaggcagttctgagagtaggggtgggttttaaggtttttgttttttagagagatgaggaaagtcttatctgagagggtgacattagggcaataaggaaaccctgtggctctctggaggaagagcattctaggtaacatgcaaaggccctgaggcaggaccttgcttggcctgttcaaagagcagcaaggaggtcagtgaggttttactaggaaagggattaaagacgaaatcagagagttttggaagaggggaaagtttagaagacttgcaaggtcacatagagtccttgagggactctggctttgatctctgaatgaaatgggaggttcatgagcagaagggtgacatggcctgaggtgcatgtgaaaaggattactgtgaaaactcatgaataagggactctggaggaagcgagtggaccagttagaagttcttatactcccaagtgagagatgatctggcttggattgcagtgtaggtggtgaggtcattttaaaagatagagccggaaggttttgctgatcaattagatgaaggccataatagagaggaatccaggagaatctacctgattttgacctgaataatgcaaaggatacagttgccatttactgaaatggaaaatgcaagtcttgggagaggaaactgggtgtttggttttgaaaatgttaacttcaagataccttgaatgacaggttagaaacatggcagctgtatttggtggagatatttagacacagatatacattgaggaattttaaaccacaaatttgaaggctatcctttaggtaatgactgtaaatagagataataaaaggtcctaggtgtgaaagttgcacataccaggatgaaatcacttttgtcagacccagacaaaatagggcaagaaaggcctgaaggagaagaggcccatgcttacatgtctgagataagaactgttcccaaggactttctaaaaacctttcagtcatcccctgctttgataaggtttatcactagacatcctttaggactgcagtaatccagataagatgtttttggaagaccgcttacccagtaatacatctccacttattaattgacaatcactctggctttgagcctctggaactaatgaactctgttcctaaatagctcacatatattcctttttggtaataaaagcttccctttatcctttccctcaccaaatgcactgctggcttgccatgtcatgcattctgtattatactccttatttatattctcaagtaaacccaacaaatttgaagataatcttccctagtgtcttttttaggctgacaaaatatagagctctgggtcactatgaatttatctgaaatgaagatgaatcagcaaaagagactgagataaagtttccaggaaggtgggaggagcagcaaaagggagtcctgtcctggaagccaaatggaggaagtgaagagctacattaaatgctcggatagtaaatgtttcataagtaagataaagactgagaataagccattcaatctggcaatggggaaatcatcagtgactttgacaggagctgtttcagtggagtggtgaggacataaaacatgactaaactagataaaagagaagagagaaaatagagacagacagtgcagacaactcttttgattttttttcataaaaagaaacagagaaattgggtggtagaggtcaggaacaaagggagggttatatttttcaaaagggcaaaggctacagcatgcttaaaagccaatgggaatgatccagtaaagacagagacaatgacaatgcagaaggaagagaggaaagttttggagcagtgtcctccagtaggcaggcaggataagatctagtacccaagtggagagttgaccttagggcaatggtaattcatccatagcaatagcaggaaagatcaactatatgggtacagatgtcaatgcattagtcaatgagggaggctgtggtatttctcattgcttctgttttctcaggaaagtaggaagcaggtcttcaatagagagtgaggaagggaagatactagagaggagagatgacagaaaaagtaatgaagcaatgacctggcttagcaagacagtgacttggctagtgaaatgtagtaggattactgtgtggctctccgggcccagttgaggttagtggtcatgaatataaagcagtatcagtcagcaaggttctgtttgtctccagccacaattagctctctgggctcataatcagtgaggaaatggattctaaaatataaactacattttgagtcctaaaggaattactgaaacctaacgtagccttaaaaatagtatttggaatcacacctaagaactctttctggttattaaaaatatgcatgtagagaagctgtggcaaaaacaaacaggccttatgaattagcagagtaggccgctgaatttaagggctctaacatgatactgcatctgaaaacatttgccttattggtcttctacggtgcgtgaaaatcccaacattgatgttattctaaactgtttatgagcttgtcatgcacagagatgatctcttttttttaaatatctacagtttaatacaattccaggaaaccatcaaatgctaaataaatatttgctaagatgacttgaatggaacagaatgcagggctatcattcatgcatttttattcaacaaatatttatggagtagaatacactgagccagacattaccagtgtttccaagataaataaaaaatatatttacatgaaattgctgaagatagtgggactacagtagggagatggttattagcactggttttgttttttttttggtttttttttttccctatcattaccctttgaaacagcaaaatacaggaggtaaaagaaggtatgtgaacagccaggaggctctgtctggtgaggccaccgcaaaggagctgggaagaaagaaagctcttgaagcaaaacagacaaaattctactttacaacttcaccccaacatgaggaggcctgtgatggcacctatgttgccataggggaaacactgcctttctgcaactggagaaatgagtaggtggtctcaggtaaaaagcttctctctacatgtgattttactggaaaactgaaccacatgagttagaagtgaaaccttgcacatgctgatctctgcctagttaccaatgtggaaaataccctaataactgaacgtttagaagagctcctttaaacataatactacctcgaccacaacattcattataagtcagctttctccttgagggaaagattttttctggtagttagggaaattgacttgctcttttctttctttttttttgagacagggtctggctaagtcgcccaggctggagtacagtggctcactgcaacctctgcctcctgggttcaagccatcttcccaagtagcttggactccaggcacccgccaacacgcctggctaatttttgtattttttgtagaaatttttatattttttgtatttttcgccatgttgcccaggttggtctcaaactcctgagctcaagcaatccacctgcctcagcctcccaaagtgctgggattacaggcatgagccactgcgcccagccctcttctctaatttttttcaactcattagtttgtttgtaactaatcattagataaataggtgtttgtttccttttctgacctgtctatatttataagttagtcctttgacttttctagaggagaacattcacttttatgctaaccttttatatcttttatgtcctgtttagaatgtaataaaatcccattaatctggcctccatcaattcagaacttggttaggtttatcagagtttggttatagtttattgttggattttaagaaagaagatgggaaaaataatttataaaatatatatgaccttatattattacttaactagacagtgaaggggagattcaggaaatgtctatttctagttatcaactagaataattactcaacaaatatttattgagcatttactatgtgtcaggccccattctagattcaatcaacatagcaatgaaaaaatcaaacaaaaattcttgcccacattaagcctacattctagtttgaatgaataaatgtactattgacatacaaaaaataagtctttctattagagcacatgcaacatctctttctagatttttccaaaattattgtattacttaaaaatatatgaataaaattatctataatatcctataaataataatttttatggctttacattaatatttccctcaatcaaatcggtcaggtttcccttaggccataatattataatatcctttgctatagtctgaatattagtgtaccctcaaaatttacatgttgaaacttaaaccccaatgtaatagtattaagaggtggggcctttagaaagtggttaagtcatgagggcttttccctcatgaatcaatttagtgcccctataaaagaggttgaagggagctgcctggccccttctactatgtgagaacatatagaagtcaccatctatgaagaacagaccttcaaaatctgttgacacttgatctgggacttcctagcctccagaactgtgagcaacgaatttctgttttttacaaattacgcagtctaggtgctttgtcatagtcacctgaagggactaagacatcattttgtgttgtacttaattctaagcatttcctatatgcaagtcacttcctataatttgcttttttataagctttgtggcattaattatcctcatttcacaggaggctgaggctcagcaaggctaaataactcttctaagattacacagctagcaactatggcagacactgttggatgacggtatccaactccatttacaatgcccttctgccaggttcccatccagacagagtagacatgtgacactgttgtggccaactcagtgtaggtcgaagtccacaggaggaactcctttgctctttaccacttttcctgcctggaacttggataagaagcctggagatacagcatctgaagattaaggtcaacacactgaagatggcagagtagaaagaggaaaagagcctagatccctggggtattactgaattatcatgccatctgttactacatataattatgacctgatataaataagtccatgtctatttaagtgactgcacttgagtttttttatttttcttttatttttttgttttttgagatggagtctcactctgtagcccaggctggagtgcaatggcatgaactcagctcactgcaaccttcacctcccaggttcaagcgattctcctgcctcagcctcccaagtagctgggattacatgccctgctaatttttgtattcttagtagagatggggtttcaccatattggccaggctggtcttgaactccggacctcaagtgatccatctgcctcagcctcccaaagtgctgggattacaagcgtgtgccactgcgcctggccagcacttgagttttctgatatttgtatcataaaagacacctgactggtaagtttcagaactggaaattaaatctaaaactctaaagcccatgctcttcccaatgaatatttctgaaagcattctctttagtaaactcattcttaatactttcagagtgactttttgagtactgagaacaatcttagtactcataactactacaaatattccttactttataaagtgaatgtgttcctcaaaagtcatgtgtaaataaatgtaaacatacataattttgaacacattaaaggattttaaaagaaatatataatacatagtcatataaaatattcagaaaatatttttatgatactaaataggaaattaggtgggggttagcaagtttaaaattgtatccaacaaatatattttttcaaattgtggttcatctgtctggaatttgcaatgcagttttactatcaggaacctcagaaggcaggtacgtcaggcttgaaagaattaacctgcatccactaggatggcaataaccaagataaaaacaaaggttggcaagaatgtggagatactggaacccttatacactgttgttgggaatgtaaaatggtgtggctgctttggaaaacattatggcagttgaacaaaagattaaacatagagttaccaagagacccaggaattctattcctaaatatatgcccaagagaaataaaaatatgtctacacaaaacgtgtacacaaatattaatagaagaataattcataatagctgaaaagtggaaacaaccaaaaagttcatcaaccaaggaataaataaataaaatgtgttccaaataatggaacattattaaaaaaaggaataaagggccaggcgcgttggcttatgcctgtaatcctagcactttgggaggccaaggcaggagggttgcctgagctcaggagttccataccagcctgggcaacatggtgaaacccagtctctactaaaatacaaaaaaaatcagctgggcgtggtggcgtgcacctgtaatcccagctactcaggaggctgagacaggagaatcacttgaacccaggaggcagaggttgtagtgagccgagatcacaccattgcactccagcctgatacatgttacaccatagataaccttgaagacattatactaaatgaaagaagccagtcacaaaagaccacatattatatgattccttttacatgaagtgtccagtgtaggcaaatcaacagaaacggaaagcaaatagtggctgccatagactgggaagattgaggggaaataggaagtgactgctcatggatgtgattttttttttggcatgatgaaaatgttcaatattgattgtagtgatgggtgctaaaactcaaggaatgatatactttaaataaggtgaattgtatggtagatgaattatacttaataaagggttatattaaaaataaaagaaagaatgaattaaccaaacaaccaggataagcagttcaggagatccttccaggttctgggagatagtgaagatcctcaagacactaggctatctctgtcaatctggcactgcctggtttttctgtgtgcttgaagtgcaaagtttgctgccatactgccctcaccttcacattcctaaagttgacttagcaatgagactctagttgtcttgctctcatggcttttctactttaccctataggcaaggggtagaggtttagtctccagtggtgtagccagagaaatccctgttagaatccctgctcctttacttcttagtcaagtgactttggagaggtaatgtgagctccccacgccatctgtaaaatgggaacaataacgatagttccctcacaaggttaagttgagaattgaagatgtcatgcacatgaagtacagagcacagtacttagcatattgcatctcttcaatcaattccacccatccctgatatcagagttttcatcacctctttggtaccagaatatgcctctgtttaactcctgttcagaatgaaaggtgtacgcctcttgccaatggcatgtagctggtaactctaggcctggcaatgtgttcataaaatctgtctagtttctacgtggactttcttgactgatgaggtgtttctttttaggtttcacttaatcaaaattattctgagtatccaaaaagtggagagagagagcaagattaggttattctcttccatagagatcaggcttggtggctgggagaattgcttgaaacccaggaggcagaggttgcagtgagctgagattgtgccactgcactccagcctgggcgacagagaccgtggctcaaaaacaaaaacaaaaacgaaaacaaaacaaaacaaaaaccctataaataaataaaaagattttttttaaaaagaaggttattcccttccataatgatgagaactgagtagaatatcttaaatatgccctgcgatctggtcctccacacaccttcagcagaaaataagttgagaagacagtcaggcaacctatgttcaaattccacctctccttctctgcagctgtgtggtcctggatacattcattacctgacctcactaagtctcagttcccttgtctatacaaatgggaaaaataattgtatgcagctgtcttagtctctttgagctgccatacaaataccttagactaggcaatttataaacaacagaaatttattgtttacagttctggaggcttggaagtccaagatcaaggcatcagcagattcagtgtctggtgagggctcactctctgctttacagacagcaccttctggttgtgtcctcacagggtagaagggcaaacaagctctctttcaggcctcttatggaagggcaataattccatccatgagggctttaccctcatgacctaatctcacttcaaaggccccaactcttgttactattgcattgggggtttgtttcaacatatgaattttaggaggatataagcatttgtatgatcccagggcttcacatggttgtatagggtattaaatgaggcagcatttataaagctcttggcccagtgcttggcaaacagtaagggtccaataaatgctttacaaaatggtttgtgaaatttttaagaattagtgacagaaaaaaaaaagcatacttcaacaacaccacagaaggcttattttattttattttattttattttattttattttattttattttatttattttattttatttattttttgagacagagtttccctcttgttgcccaggctggagtgcaatggcacgatcttggctcactgcaagctcctgtctcctgagttcaagcaattctcctgtctcggcctccccagtagctgggattacaagtgtgtgccaccacacctggctaatttttgcatttttagtagagacggggtttcaccatgttggccaggctcatttcaaattcctgatctcaggtgatgcacccacctcagcctcccaaagtgctgggattacaggcgggagccaccgcgcccagccggcatcttattttatttattattatttttgagatggagtctcgctctttcgcccaggctggagtgcagtggcgtgatctcagctcactgcaacctctgcctcctgggttcaagcaattctccctgcttcagcctcctgagtagctgggattacaggcgcccaccaccacgcccagctaatttttgtatttttagtagagatggggtttcaccatgttggccaggctgatcttgaactcctgacctcgggtgatccaccagcctcagtctcccaaagtgctgggattacaggcatgagccactatgcctggcctggaattttattttttaataaactaaacaaaacaagaaacacggataaggtaagcaacttgtcctagtttgcccacaactttccaggttttaaaactgaaaatcctttgtcctgaaaacccccttagtataaggcaaacaggaaagttgatcagctatgtagacactaaatttaagatctgagggtcattattaacaatagcttccatgaatttagtggtaatatggcataattatatacactttaaaagccaaattccacataattaattagaacaaacctgtgtgttatgttttatttttaggcccatttaaagattaaaaataatagcaattcggggaaattaagttgttgaaaccctagaagaagaatagagcagggatttaagcaataatttattattttattttattttttgagatggagtcttgttctgtcgcccaggctagagtgcagtggcacagtctcggctcactgcaacctctgcctcctgggttcaagcaattctcctgcctcagcctcctgagcagctggaattacagatgcctgccacaatgcctggctaatttttgtattttcagtagaaaccaggtttcaccatgttggccaggctggtctcaaactcctgacctcaggttattcacccaccttggcctcccaaagtgtgggattacaggtgtgagccactgtgcccgtcctaagcaatggcttaaaactgtgctaggctgtaccaccattaggagcctgctaccagttacctactaatgaataaaaaggacagaaagatcatagagcactttgcctgccagagtgaaaatattaatggcttgaaaagggctttggtagtttcactgatcataagtaggaaataagggataaatcagggtatatatttaatgtttgaggctgatttcttggatctctgctggaggcagagctctggctgaactggggtggaactgcttatatgaagccgtgaggaagtgacctacctcttcacatgtaccacgtattttgtgtctatgtaggtgagcttcccagcattccaggtgcaagtcatgttgcctgaatattcataaatgacacaggttacttcatcaggaatatctggcggatctgcaacaaaacataacacttaggaggtgctgtaagaaatacgaagttctctggtcccaagccaagatggctgaataggaacagctccagtctacagctcccagcgtgaatgatgcagaagacgaacgatttcttcatttccaactgaggtaccgggttcatctcactggggtttatcagacagtgggtgcgggacagtgggtgcagtgcacagagtgtgagccgaagcagggcgaggcattgcctcacccgggaagtgcaaggggtcagggaattccctttcctagccaaggaaaggggtgacagatggcacctggaaaatagggtcactcccaccctaatactgcacttttccgacagtctcagcaaatggcacaccaggagcttatatcccatgcctggctcagagggtcctatgcccatcaagcctcactcattgctagcacagcagtctgagatcaaactgcaaggtggcagcgaggctgggagaggggtgcccgccattgctgaggcttgagtaggtaaacaaagtggctgggaagctcgaactgggtggagcccactgcagctcaaggaggcctgactgcctgcctctgtagactccacctccgggggcagggcatagctaaacaaaaggcagcagaaacctctgcagacttaaatgtccccgtctgacagctttgaagagagtagtggttctcccagcacacagcttgagatctgagaatggacagactgcctcctcaagtgggtccctgacctctgagtagcctaactgggaggcaccccccagtaggggcagactgacacgtcacatggccaggtactcctctgagacaaaacttccagaggaacaatcaggcagcaacatttgctgttcaccaatattcgctgttctgcagcctccactgctgatacccaggcaaacagggctggaatggacctccagcaaactccaacagacctgcagctgaggttcctgactgttagaaggaaaactaacaaacagaaaggacatccacaccaaaaccccatctgtacatcaccatcatcaaagaccaaagatagataaaaccacaaagatggggaaagaacagagcagaaaaactgaaaattctaaaaatcagagcgcctctcctcctccaaaggaatgcagctcctcaccagcaatggaacaaagctggatggagaatgactttgacaagttgagagaagaaggcttcagaagatcaaacttctccgagctaaaggaggaagtttgaacccatggcaaagaagttaaaaaccttgaaaaaagattagacggatggctaactagaataaccaatgcagagaagtccttaaaggacctgatggagctgaaaaccatggcacgagaactacatgatgaatgcacaagcctcagcagccaattcgatcaactggaagacagggtatcagtgatggaatatcaaatgaatgaaatgaagtgagaagagaagtttagaggaaaaagaataaaaagaaatgaacaaagcctccaagaaatacgggactatgtgaaaagaccaaatctatgtctgattggtgtacctgaaagtgacagggagaatggaaccaagctggaaaacactctgcaggatacttccccagagtaggatccaggagaacttcccaaatctagcaaggcaggccaacattcagattcaggaaatacagagaacgccacaaagatactcctcgagaagaccaactccaagacacatgattgtcagattcaccaaagttgaaatgaaggaaaaaatgttaagcacagccagagagaaaggtcgggttacccacaaagggaagcccatcagactaacagcggatctctcagcagaaactctaaaagccagaagagagtggaggtcaatattcagcattcttaaagaaaagaattttcaactcagattttcatatccagccaaactaagcttcataagtgaaggagaaataaaatactttacagacaagcaaatgctgagagattttgtcaccaccaggcctgccctaaaagagctcctgaaggaagcaataaacatggaaaggaaaaaccagtaccagccactgcaaaaacgtgccaaattgtaaagaccatcgaggctaggaagaaactgtatcaactaatgagcaaaataaccagctaacatcataatgacaggatcaaattcacacataacaatattaaccttaaatgtaaatgggctaaatgctccaattgaaagacacagactggcaaattggataaagagtcaagacccatcagcgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaaaaaggccattacataatggtaaagggatcaattcaacaagaagagctaactatcctaaatatatatgcacccaatacaggagcacccagattcataaagcaagtccttagagacctacaaagagacttagactccccacacaataataatgggagactttaacaccccactgtcaacattagacagatcaacgagacagaaagttaacaatgatatccaggaattgaactcagctctgcaccaagcagacctaatagacatctacagaactctccaccctaaatccacagaatatatattcttctcagcaccacaccacacctcttccaaattgaccacatagtcggaagtaaagtactcctcagcaaatgtaaaaaaacagaaattctaacaaactgtctctcagaccacagtgcaatcaaactaggactcaggattaagaaactcactcaaaactgctcaactacatggaaactgaacaacctgctcctgaatgactactaggtacataacgaaatgaaggcagaaataaagatgttctttgaaaccaacgagaacaaagacacaacatacccgaatctctgggacacatttaaagcagtgtgtagagggaaatttatagcactaaatgcccacaagagaaagcaggaaagatctaaaattgacaacctaacatcacaattaaaagaactggagaagcaagatcaaacacattcaaaagctagcagaaggcaagaaataactaagatcagagcagaactgaaggaaatagagacacaaaaaacccttcaaaaaatcaatgaatccaggagctgttttttttgaaaaaatcaacaaaattgatagaccactagcaagactaataaagaagaaaagagagaagcatcaaacagatgcaataaaaaatgatacaggggatatcaccaccgatcccacagaaatacaaactaccatcagagaatactataaacaccttgatgcaaataaactagaaagtctagaagaaatggataaattcctggacgcatacaccctcccaagactaaaccaggaagaagttgaatctctgaataggccaataataggctctgaaattgaggcaataattaatagcctaccaaccaaaaaaagtccaggaccagatggattcacagacaaattctaccagaggtacaagaagaagctggtaccattccttctgaaactattccaatcaatagaaaaagagggaatcctccctaactcattttatgaggccagcatcttcctgataccaaagcctggcagagacacaaccaaaaaagagaattttagaccaatatctctgatgaacatcgatgcaaaaatcctcaataaaatactggcaaaccgaatccaacagcacatcaaaaagcttatccaccatgatcaagtgggcttcctccctgggaggcaaggctggttcaacatatgcaaatcaataaacgtaatccagcatatcaacagaaccaatgacaaaaaccacatgattgtctcaatagctgcagaaaaggcctttgacaaaattcaacaagcttcatgctaaaaactctcaataaattaggtattagtgggacgtatctcaaaataataagagctatctatgacaaacccacagccaatatcatctgaatgggcaaaaactggaagcattccctttgaaaactggcacaagatggggatgccctctctcaccactcctattcaacatagtgttggaagttctggccagggcaatcaggcaggtgaaggaaataaagggtattcaattaggaaaagaggaagtcaaattgtccctgtttgcagatgacatgattgtatatctagaaaaccccatcgtctcagcccaaaatctccttaagctgataggcaactttagcaaagtctcaggatacaaaatcaatgtgcaaaaatcacaagcattcttatacaccaataacagacaaatggagagccaaatcaaaagtgaactcccattcacaattgcttcaaagagaataaaatacctaggaatccaacttacaagggatgtgaaggacctcttcaaagagaactacaaaccactgtacaatgaaataaaagaggacacaaacaaatggaagaacattccatgctcatggggaggaagaatcaatatcgtgaaaatggccatactgcccaaggtaatttatagattcaatgccatccccatcaagctaccaatgactttcttcacagaattggaaaaaactagtttaaaggtcatatggaaccaaacacaagcctgcatcgccaagtcaatcctaagccaaaaggacaaagccggaggcatcatgctacctgacttcaaactatactacaaggctacagtaacaaaaacagcaggatactggtaccaaaacagatatatagaccaatggaacagaacagagacctcagaaataacaccacacatctacaaccatctgatctttgacaaacctgacaaaaacgagcaatagggaaaggattccctatttaataaattgtgttgggaaactggctagccatatgcataaggctgaaactggatcccttccttgcaccttatacaaaaattaactcaagatggattcaatacttaaacataagacctaaaaccataaaaaccctagaagaatacctagataataccattcaggacataggcatgggcaaagacttcatgatgaaaacactaaaaacaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaacaaccccatcaaaaagtgggcaacagatatgaacagacacttctcaaaagaagacatttatgcagccaacagacacatgaaaaaatgctcatcatcactggccatcagagaaatgcaaatcaaaaccacaatgagataccatctcacaccaggtagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgactgagccatcccactactgagtatatacccaaaggattataaatcatgctgctgtaaagacacatgcacacgtatgtttattgtggcactattcacaatagcaaagacttggaaccaacccaaatgtccaacaatgatagagtggattaaaaaaatgtggcacatatatagcatggaatactatgcagccataaaaaatgatgagttcatgtcctttgtagggacatggatgaagctggaaaccatcattctcagcaaactatcacaccacatgttctcactcataggtgggaactgaacaatgagaacacatggacacaggaaggggaacatcacacaccggggccagttgtgtggtgggaggaggggggagggatagcattaggagatatacctaatgttaaatgatcagttaatgggtgcagcacaccaacatggcacatgtatatgtatgaaacaagcctgcacgttgtgcacatgtaccctaaaacttcaagtataatttaaaaaaattaaatagataaataaaaagtcactggccagaaaagttgtgatgcaattataaacattgattgcttacctaatcattagctttacctgattaaacttatcaacttttcactgaaaagggaatttattttaaattagtatgtctcaacttgtctgaaaagataataaatttgtaatggaagaataaaaaaaaaagaaatatgaagttctctatagtccgttgagaaactgacaattttatttgagaagtcaggccaatcagtactcagcacctccctgctcctcattccatccctactaccttaccttgcaacccactttaccatcaaatatccattcctcttcttcttatacttgactatattatcctaaattcagtctcccccagctactcctgtatctttctttttttcttaacagctaaacacttttaaagagcctattattcttcatttcccatatgcatttaaacccaaaacaatcaggattcagcctccacaattccaccaaaaccattgttgctaaggtcattgatgactttctcttcaacagaccccatctctggtcatttgtcattgagtttgagtttgatgtcattgagcagcatttgatattttgctcactccctccttgaaagctctctgttttaaagctgggtgtggtggctcatatctgtagtctcagctacttgggaggctgaggctggaaggattcctggagcctaggagtttgaggctgcagtgagctatgaccaagacactgcactccagcctgggtgacacagtgagaccttgtctcaaaaacgagacaagaaaagaaacctctttgcctttggctcttgcgaatgggttctttgtagttttcttctactactctggcagactatcttcttctcttgcacattttccactactcattttaaaagttgggtgttcatacatgcaataagatattactcagccttaaaaaggaaggaaattttaacacatgctacaatgtggatgaaacttgaagacattatattaagcgaagtaagacagaccctaaaggaaaaacattgcatgaccccttacacaaggtatctggaagagtcaaacttgtagaaagtagaatggcagttgctggggcttggaggagagggaagtggatatttgtttaaaggctgcagactttccatttgcaataagagggttctggagataaatggtggtgatggttgtacaacagtgtaagtgtacttagtgccactgaactgcacacttaaccatggtaaaaatggtacattttatgttatgtattttaccaccaacacaacaaggtttttttaaagtttggtattcatgcaactctatttcaaggctcttttcctgtcactccactcaactcatcccacccccattcctgcccagctctttctccaggtggccatgttatggcaaacatttttatttttcattggctagcgtctttccctcttgagaactgacatcccctccagcccctcactccaatctcacccccaccccaaccccaagacctgtcaatcaagaggctctccacagaagtgtgcctctgaggtaggccgactaataggagtgtgcctttgggaatgaacatatgactcaagatgaaccaatcagaattctccaaggcactttttctaaaccactgtaaaagaagcacactctttcctcctgaaactgctatctctgagtagcatgtgagctgtaagttgctggtggccatcttgctgtcattgtgaaacaggctttttcacagtctttagtctatttaagaatgaagccaacacaggggaaaacaatacctagcagactggaaaagatgagagagttctgatgacattgagttttgggggcctctaaagcctatgaaaccccaacaactatagaatgacacctagaattttcagttatatcattcaatagtgaataagattaagatttttttaagtatagaaatattgagtgtttgttaaatattcacttttcaggtgtggctctcttagttcatccctacgtgtgaaatactgctgggacacttgactgctcagagaatgacaagacaaatggaaggataggggctcataaagaatgaaaatacagacatttatgcgtctgaagttacatccaaagatttatcttaagtacatatatgctttcacttcacctgcaaattgcttaccaaaaatattgcttgtagaacaataaacaaatatattaaaaattttattctcactgcaaatcaaggcaatactagatgtcattcaagcctatcaaattagcaaggattttgaaaaatgatagtacacagtgttggagtggactcatggaaatcctctaacacacttctggtggaagtacaaattggtacagcctttatggagagcactttacatatcacaatctgtaaaagcaggtgtaatattttgcaactcagcaattatacatctaagaatgcatccttattgaaatgttcatagatatataaaatatttggcttaaaggatgttcccttattgttcataacaatgaaaaaattgtaaacaaacttaattttccaaaataaggttaaataaactataatacagtcctaaacacatccaaaagcaatgttgaagaagacagtttaagtacttggcctttggaaggaattaaaagtatatgtagtgaagtcatgatcatatggcaaagtgaaaaaagcaggttgcaaaatggttcaattagtggtttcatttaagtgagagactgagaaagagagggtctgaaatttcaaagacatattccaaattattaaagagggattatggttactagtaaagttatggttttatgggaatgataggtatttcttttttgctggtctacattttaaaaactctctatattcaatgcaatttgattttataattaaaaaactattttcatatatcgaaggtctaatatccttttaaaaaaacctatattcaaacagtaagaacacactaaaaagtactttacaacattttggcgacttgtagcattgagttacaatggagagaaactgggctccaagtagggtaaaataaatctttgttttaattgagccttaaatgaagtaggtgtggaaacataaatttaaatcattttggagtttgagttgtggtccctcattgattacaatgatttgtgctgaagttattttttcctctggtttcagatacagagtgccattgatttggctatcagattgtttgggctgtgttactccacggcatctacatgaagtgaattcttggggttacaaatgtctggtggtcaattaactttgcaaaagatcaaaaagatgactatacacacacatgcaaataagtgtttgttaacatgaagcaatgtaaagatgggcctgtgagtatgcttatgataataacatcaagttgttgttaggcctcattgccaggttattcaatatccaagaacaaaacctggctatacaactagatactagagaatactctgaggtatacaaaagggggcttatgtttttgctctttcttgccaatcccacccctcccctattattgggacactcaggaatcacaggccaggtttcttgttaattcagagtctagccaaggatccctttctactgagaacttcttgaaaacagtccgtgatttcctcttctttgtacttctagcatttaacacatttttggtgcatagtaaccactcaataaagtttattccatgaattgattggcttgattaagataataacatgaaggattaaaatggagagagatgcaatgcttctggcaaagatcactctataatttcttactcaagcagggcacaggccagcctaattgttccgtaatcatacttaatagcaatgttagaaacaaatattcagaggcttttattgaataacaaatgtgctttcatcattgtaaataaagtccaaaagttaaaatttaaaaagtcaaagatatttaaaattttaaacaaatgattaagtggaaacatgactgtgcatggtttaatttggtatttttaaatgaataaagacatcttgtattttatcccatgattggtgtggcctgattagaacaaatttcccataatatgtgtgcatttagtcttagataagaatctaagaagtgtctaggattgtggctaaaaatggaaattgtgataatatggtttatatttcacaaattatacattaaagcacagcactttaaaatatatttggatagcttttcaaggaaagcaatgactcatttatcttgtcttttacaatttgtctctagtctaaaaaaatacatataatcattttgttcaaagcagtgatgataagttgacataataaatctcacatgacaaatatcctgtgatcaaagtggtccagtgaaagcaatgtgatttctagaatgccacaaaaccctcaaaaacccttttttgacctacttaaataggaagttttgtttgctaagaatgtagagctcaagaagacattcagcttgaatccaggggtttgagtaaattctcacctggcagttacatttttacactcataaccagaggcctatgtaaggagttacaattcacaaactcaaaagttaaataagtggaaagagtgatgttctttctaagcagccatcggcagagaatgtatttctattaggctgtcctggaagaggaacaaagtccattctcttaccttctacattgcctggtgttgggtttggggacagaggccccccagccaacacttgggagggcttttgggagtaatcagttatacaaactgcaacacacggaaggtggtgttaaataaaatgtataggagaccattgttttggactgagctcctgcactaggcccccacataccaaaccaaaatgaagtcactcctgttaagtgacatataaccaagctgaaactttaaggaagcaggtaaaactcccacagactagtttttcctgaaaacagaaaattcacagcaaccacgtagaaagagcccagtcaacctgagcagggatgataaggaaatcccctctgctttaaccattacaaggaaaataacctgaagtaacaatgttaaccaatctggtagtttttataaaaatttctatttcttgttcctaccttacaaaaaccaactgttctgttagaatagtagagccaaaactaagtatataattatacaagccagcccatatcactatagtaacttaaacacctccaggacactcagagcacatatcagttttttagaaagagatgctgccgattcatgaatcacacataaaaacctatcagatctaaaaactaaatttgctgaaattttgttttttaacagagacaatgtttattttgcttccttttttttcctctggcttaaattaacaactaagcttttcctgtaactgtgaaagttgcttatttgccctccaaagaaattgtatagtctctctacccaactcccacccccaaaggataaatagtaaagtatttgggcattgaggtttggttatgtttcctgaggatgtggacaagctaagaagatttcttacatcagataagatgtctgcctgcggtttaatttccacaatttagggcaagtttagcagctttaaggcatcagtttaaggtagatttattctttgactccaaaacctatgactttccttcctcaactcacctctacaactttctatagttccttctcttgaaaagcttgcaagatcagctgctcagagttaagtaggacaatggcctcattatagagcaaggaagcctcttactttccaagcagccacaatggggtcaggtggtagtggtgatatgggtctgccccccagctaagttgtaaaggtgaagaagaagcaagaactgaggcttgattctcaaaaatgtggaggacgggaacatggcaaagacacaaattcctttatttttttactgaaaatgggttcaagtgctatagagaatgaatatctgagttaaaacagtgctgaacttattgatttacacccttcataatagtagaacccaaactaggtatataattatacgagccagcccatatcactatagtgatttaaacacctccaggacactcagagcacacattgaatttagcgtatatttttaagattgacttgactaagcttttaaataaattaataattattcccttcaaggtgggttttaagaaaaagaaaaaaattaatagttacaataacaaacacagtgattctaaattggaatagtgagattaggaacagaggactgtaggagactctccctatgttttatcaaaaggatgcatttttaaggatttgggtactgatgtactttaaactttatcatatgcttccaaataaattattgaaattaagtgcataacacagcctgtataattagcctccttttacaggcgaggaattgaggcttaagcaacttgtccaaggtcacaaacctagcagtacagtgggagcacaaaactagttttgcaactctccctaaaccttggcctcaaaatttctcaatgggatctgcttcaaggttaattatattatattagtttagaaaaataaacaagaagattaaaagagcaacattttaaatctaacggggctggccctcacatatgcagtgttcgttcagggtagaggtgaaaaattgttttttgaatgtattggcaacattttaaaatttagagagtacacattaaaattttatgtttctgtcttcctttgaaaagccaaaagatgtaggaataccgggcacctgtgattactggatctgggcagtggctacagttcatatagttcaccaacctggccctggagacatttgagtttgcagctcctgtatgaaactaatctaaaaactgaactatattattttgtccctatttttagactagtgtggtaatgaccagttaattgttaaactagcttttgtttgcatttcaaatgtgccccaacacttacatccagaagaaatgtcttttccacatatcagtgtctcttgaaaatgtttgggacattcagcagtgcagtacatagaagcatgtggttccagaaagtttttataccaaagccgagctgttgttttattaatccttgtgatttgaaatctttctttgatgccatttttataaaaatgaagtttccttggttggcagttcttaattgctgcttggcaatatatagagatattcatacccatcttaaaaattgtggctggttctacccagatgtggccagagcagtttatatttgtaattcctagaaataaatggaaaaataataaattacacgtaaaacattaaatcaagagattcagaagaatatgctattgcattttaaatttatcatttctattaactaaatgattccattgaaaacagttttaggactagatgtatcttttcataaactagcctattacagtgtgtttctgttaggcttttttttttttttttttttttgagacagtctcattctgtcacccaggctgcagtgcagtgttgcgatctcggctcactgcaacatccgccttccaggttcaagcgattctcctgccttagcctcctgagtagctgggattacaggtgagcaccaccacgcccggctaatatggcgtttcaccatgttggccaggctgatcttgaactcctgacctcaggtgatccacccgcctcggcctcccaaagtgctgggattacaggcattagccacctcgtctggcctctgttatgcttttattgatgttcagcaccatgacacaagactagagtcagcctggaagcttctctaagtgtctaaagagcaaatataattagctctcctactttaaagtagagaaccgagagattataaagctacagtatttttcaaaggtaagattagaaataacactaggcactgtagaatctgaaccccattctctagctactcaaccaatcttttgttcttttttagataaagcctacttttttcagtaaagtttgaatataatgaataaaatcatactcttgccaatggcccacatagttactatgtgcccggcacaaagtaactatcaacaagtggtttgtgaaatagaattgcatccaaatgtttgacaggtaattatataacagttataatagtttgacaatagaacatgccaactcaaactaataagctcctttgtggaaatatccacatgtgagtaagagggctgtctagaagggaaatttgagaaagaaatcctgcatttggaaggagattgggccatttttatttcattctatgtaatttttatgcacacattttttctagtctaataatatttgtattcttcagagattctaacataaaaccatgaaaatgataatcactcaatattccatttgttgaatgaaagatagcaatagatacataaaacaccatacctccatgacaccagctgaagagtatgtaaagggctattactgcatcccattgaatagtgacctgattcatgtctggaagcaggaaaagactgtttccctctggaaaaaaaatatgaaaaatgtttaaattgtagtattttagtaaaataataaaaagcataacatttttccctaagaattattgtatttgatgggaacctttgattagggaggaagaaggaaagaaggaaggaagaaaggaaggaaggaaacagagcaaagaaatgttactggtatatttaggagatataacaagagatggagaagtaaagcaaataaatggaattttatactcttcaaaagtcactatgaattaactcagtagggcatttgatccattacagtgcctcctaatctagcctttctcatcagaaacctcctcctctgagttaacttctttttttattttatgttttaaatttttttagagacaagggccaggctctgtagcccaggctggagtgcagcggcattatcatagctcactgtaacctcaaactcctgggctcaagcggtcctcccaactcaacctcccaaagtgctaggattacaggcatgaaccatggtgcctgggctgagctaacttctggtgatgaattcttctccctgccaaagttacatacttatcacactccagaaatactagtctttgatgagctaaacttgggaagagccaaaaatttcagaactcccagagaaaatggattcaaaattaagaaaagtgaagtgagattaagcaatatgtgctctcaccagtgagactctaaaaagcgtttcatctggggaggcgtggtggctcatgcctgtaatcccagcactttgggaggcagaggccggtggattgcttgagcccaggagttcgagatcaggctgggcaacagggtgaaaccctgtccctactaaaaatacaaaaattagcccagtgtggtggcatgtgacggtcatcccagctacccgggaggtgaaggttgcagtgaaccatgatcacaccattgcactccagcctgggcgacagagtgagaccttgtcccccgcaccccctaaaaaagaggaaaaagcctttcatctgtagagaacgcgaaaggaacacgttatagaaattcctaataataccgttgttagtttacaactagagttacactatttgattaatcagttacatgaattaactcatttactcaatgatcaacattattcagttattttatctgtttaataaaacctgagctttttctataaaactacaagagaacgcaatgcatggctcatcatatcgcataaaatatctagtaacatttaaaaaaactggggtccccttggctcagaaatatagggatccctttcattatttgttagcaatagtaattcttctcttcataagaagcaacagaagccctaaaaatgttcctagttagaagttaactgatggaaatatgcaataattattatttaaagtaatgtgatgccatataatattatagattcccttttcatcagtaaccactgcatggaatatcatgagaacttgcaagagaaaacaacttggcccatgtatttccaaaaggaaatatagctgtctttaagtatttggatgatcgctgcctatttacctttcaacctgtttgaagcacataattccacttcagagccaggctgccacccttgttggctgtgtcatgtcttctttcctcactgcctgcctgtcagcactcactttagattttcacttctgaggtcaatggaaatgtcagcagagccctgacctacattgcagactcttgaagaggaactcaaactgtccaattcgaaatgactggctctcgtgtcactatttggggaaatccagattactgaaagtgaactgttttgtcggtactttttttttacagcttaatttaaaatggtctcatccaagaggcagaacacttatacatgttttcttaaaaatgtcaaacattttgacaccaaaaatatgacgcttagttttaatttacaaccagcattgttattaattatacacttgtttctttttttagttttccagctttgttgaaatataattgatgaataaaattctacaatttgatgatatacaacatgatgatttgatacatacatattttgtgaagttattatacaatcaagttagttaatacatctctcatcttatttagttactctttattttgcagagagaacattcaagcaaatttcaagtatgctgtataattcagtattgttaactatggtcaccatactgtatatcagatctcctgaacttactcatcttataactgcaagtttatgcccttcgaccaatagcttcctttccctccaccaccctctaaccttggtaaccaccattctatcatctgtttttatgggttcaactatttcagattctgcatataagtgagatcacgcagtatttgtctttctctgtctggcttatttcagttagcataatgccctcaagttgcatctatgttaccgcaatggcagaatttccttcctttttatggctgcataatattcctgtatagcctacagattctttaccaattattccactaataggcacttaaaatgttatttccatgtttgggctattttgactaacgcttcatgaacatgggaaggcagatatctctcatggtgctgatttcattctgtggggggactatagatccagaagagggattgctggatcctaaggtaggtctattttaattttttaaataaaattgtttttatttcacactgttttccatgataactgtaccaatttacattcctaacagcagtgtacaaggctgccctttctctgtaccctcagcaatacttatatcttgtctttttatcataggcaccccaaaaggtgggaagtgatatctaattgtagttttgttttttggttttggttgttgtttttgtttttgttttgagacagagtcttgctctgtcacacaggctggagtgcagcggcgtgattacggctcactgcaacctctgcctcctgggctcaggtgatcctcccatttcagcttcctgagtagctagcaccacaggcacatgccatcacactcagctaattttttgtagttttggtagagatgggttctcaccatgttgcccaagctagtcttgaactcctgaactcaagcaatctgccagtcttggcatcccaaagtcctgggattacaggagtgagccaccacgcccagctcattgtagttttgatttgtatttatgtgataatcagtaatgttgagtacctcttcatatacttattggccatttatccgtcttccttgaaaaaaaaatctattcaggtccagaatcgcctgatgacacatttcttagaaggtatcccagtcattaagcaacatatgactccaacactgtgtggagaattgattgaagatgaagagcccagttaggaggctatggaaaatcaagagctgatttttgttttattttattttattttattatattttattttattttattttgtgacagagttttgctctgttgcccaggctggagtgcaatggcacaatctcggctcactgcaacctctgcctcctgggttcaagtgattctcctgcctcagcctcccaagtagctgggattacacatgtgccaccatgccccggtaattttttttgtatttagtagagacggggtttcaccatgttggtcaggctagtcttgaactcctgacctcaggtgatcctcctgccttggcctcccaaagtgctaggattacaggcgtgagacgcctcacccggtctggttttttgtatttgttgtagagatagggtttcaccatgttggccaggctggtctcgaattcctgacctcaagtgatctgcccatctcagcctcccaaagtgctgggattacaggcgtgagtcaccgtgctctgcccaagagctgatttttaaatcagattttctggcctttattgtttttgtttttgctattgagtcatttgagttccttatgtattttggatattaaccttttatcagataaatgatttgcaaatatttttttcccttctgtaggttgtctttttattttgttggttgttttctttgctgagctttttagtttgatatagtcccacttatttatttttgcttttgttgcttgttttttcagtgtcatatctaaaaatatttttacccagaccagtgtcaaagaggtttttccctatgttttattctaggagtgtattagactgttcttgtgttaccatacaggaataactgagacttggtaatttataaagaaaagaggcttaattggctcacagttctatagccggtgcaagcatggcaccaacatccgcctggcttctggtgaggcctcagtaagtttacaattatggcagaaggcaaagcaggagcaggtgcatcacatggagagagcaggagcaagaggagcagggggaggtgccacacacttttaaacaaccagatctcacctgaactctgaacgagaactcgctctcatcatcaagaggatggcactaagccattcatgcaggatccgcccacatgatccaaacacctcccactaggcctaacctccagcactggggattacatttcttttcttttttcttttcttttctgtcttttttttttttttttttttttttttttttgagacagggtcttgctctgtggcccaggctggagtgcagtggcatgatctctggtcactgcaacctctgcctcctgggttcaagtgatcttcctgactcagcctcccaagtagctgggactacacacacctgccaacacgcctggctaatttttgtatattttgtagagatggtgtttcatcatgttggccaggctggtctcaaactcctaatctcaagtgatctgctcactttggcctcccaaagtgctgggattacaggcatgagtcaccacacctggccacatacatcttttgactcatccaaatgatggtatctgtagcagctgctcttttcttctcagtgtccagcacctcatggctcattcagctttgttggagaaaaaagattgaatcatcaccatttcctgtgaggtgtgcattaaaagccaatgttgacttatttcctaagagcttcttagagactttacaacgccagtaagtgaaggtaaattcaaaaccttcaacatacaactctagctcttgaagactgcgtgcacacctttaaggaggtcagttttcagattctcaaattccatatgtgctctttcctaaatctgatttccttgaaaatgagccggggttcacagtaatcattctctaaattcatagtgaatagcatccctccatctcaaatctcatgtagtgcattgccttgggtgtaaatagctccagaatatcaaacaaatggataaatggaaatactggttttagggagggctccttggataattaatcaaggtattttaaacatccaagactttaagccttttcctgtcatatagatatatgtgaagctcactaaaatatttctatttcagcccatgctgggatactcagaattttagccaattcagggatatttgagcccattttggatctctgaatctaggatatcgaaggaatatgggagacttatggctatcctcttgaacataaatgggatttttttttctttctctgtctcccaggctggagtgcagtggcgcgatctcggctcactgcaaactccacctcccaggttcaagcaattctcctgcctcagcctcctgagtagctgggactacaggctacatgtgccaccatggtgccacatgtgccaccatgcccagctaattttttatatttttagtagagatgggtttcaccgtgttagccaggatggtctcaatctcctgacttcgtgatccgtctgcctcggcctcccaaagtgctgggattacaggagtgagccatcgtgccaggccataaatgggatttttgatgaaccattacttttttttttttaaacattggataaaatttatatgtaaaattttacttgatttctttcagatttggttaactttattcaataagatagtaaaaggctattttatcaaatcatatcatggcatatctgtgtctttaacagcctcgtcttagttttttcgtctttgaaatgttcaatcactctattatatttaaaagaaagtaagtttatttagagctttaaaaatattttgggcctggaatggtggctcacgcctgtaatcccagcacttttgttggccgaggcaggtggatcgcaaggtcaggaaatcgagaccatcctggccaacatggtgaaactccatctctactaaaaatacaaaaattagccaggcgtgttggctcatgtctgtaatcccagctacttaggaggctgaggcaaacgaatcgcttgaaccagggagtcggagtttgcagtgagccgagatcgcgccacagcactccagcctggcgacagagtgagactccatctcaaaaaaacaaaaacaaaaacaaatatatatatatatatagtattttaattctaaaatatgcaagggagtacgtagtttgaaaatcttcttttaagaagactcaaggaaaacatttgaaagaccactgcattgaagctcaactttataagccaaacaaaaactatatgtagaaaaaaatacaacaagctatcaatagtagttttctttggattatggaattatgatttttttcttccttttgcttttctataacttcctatttttaggaggagtatattatatgtgataatttgtaaataatttataaaatactgaacacattaaagacaagaaaaacttcaaggaaaggaacgtaaatagaggattcttcctagtcaattctagaatatgagatagctgcagggaattactgactggcctactgatgtacgatttcacttaggcaaattcaactatgagtggaaggggagagaaagattttatcccattaacttccccttcccgcttgttctgtctgcttcaaaattgacctagagcctcagtgactgtaagtaaaaaaggccatttcagaaatgcaatgataatagttattgttaacagtgacacattattattacttattagtattattgtttggatggaaaattggtatcaattgctataaacaatagctgatgataaggtaaataaggttttattgattcactcttgccaatcaataagaaaaaatcttatgaagtctttcataatgtcctaaatacttttagagaatttttcagataaagaatagagctctgctagctgggcatggtggcacatacctgtagtcttagctgcttctcaggaggctgaggcaggagtattgcttgaacccaagagataaaggctgcagtgagctatgatcatgccactgcactccagcctaggtgacagagcaagaccttgtctcttaaaaaaaaggggaacaaaaaagaatagagttcacatgatcaaggtgcacacccatcattctgttttgcagatcttctcattcacttggccttcacatataatgtaagtgtgcattctaatagtgattgtaagttgtccaaattaacaaagatatcaataagatagtctggtttgcaaatctattcatacaaacaattctaaaacatgaggattttctccagaaagatttagggtgccatctattcaaatgaaagagtgaggatccatctgcatagaagccaatggtcttcagtggtttttacaattcaattggcaatttgaaaagtaccatttaaacacttctctccaaacttcaagtgcattctcaggtattttctgtttttgttttttgctggtgtatacaacagtgactagattgtgttttcaagcaatcattttaatacttcagtactcaacaattgtcagcttctcaaagtcatatttcaatttagtgctgaaaataatgcaggaatgagcttgaaaattcagttcatgagaacgtaccaggctgggcgcggtggctcatgcctgtaatcccaacacttttggaggtcaaggtgggtggattgcttgagtccaggaatttgagaccagcctgggcaacatggtgaaacctcatctgtattttttaaaaataaataaataaatattaaaaatttaaaaacatactagtgaatagcatcatccaagttatacattcttatgaacagttacaggagaaaattcagtccctgcaggtgtataacaatcatgggcaggtctgagtcttcttctgtaattaatgcgtcgtacagattactacagctctacctgctttagcctcatcctaataagtcatatccagaaaatcacatttgtgatatgctgttttatttttcctgatacacattaaaataagcatatggctattaaataagaatgtttatgtagcatctatcacagacactatcatagcatgctacagcctcaaactcctggcctcaagggatcctccagcctcagcctcccaagtagggaccacaagcatgcaccactgcatgagaattattatttatcattttggtccatccatctttgtcctgacttatatacttgtattagtttgttctcacactgttataaagaactacctgagactgagtaatttatgaagaaaagaggcttaattgactcacagttctgcaggtttaattgcagaggtttaattgactcacagttctgactcacaagaagcatgactaggaggcctcagaaaacttacaatcatgatggaagacgaaggggaagcaaacacctttttcacatggtggcaggagagagagcgagcaggggaaagtgccacacacttttaaacaattagatcttctgagaactcactcattatcactgatagtgatagtctcactatcaatcactgatagtgatagtctcactatcaatcactgatagtgatagtctcactatcaatcactgatagtgatagtctcactatcaatcactgatagtgatagtctcactatcaatcactgatagtgatagtctcactatcaatcactgatagtgatagtctcactatcaatcactgatagtgatagtctcactatcaatcactgatagtgatagtctcactatcaatcactgatgatagtgatagtctcactatcaatcactgatgatagtgatagtctcactatcaatcactgatagtgatagtctcactatcaatcactgatagtgatagtctcactatcaatcactgatagtgatagtctcactatcaatcactgatagtgatagtctcactatcaggagaacaccaagggtaaaatctgcccccatgatccaatcatctcccaccaggcccctcctccaatttcacatgagatttaggctggcacacaaatccaaaccttatcaatacttatctacttttgaggtaagagatggtacttcactccagaggcaggacttggacaccagaccaaactgaggactagctaaaacaggtccaaagcaaagtagctttccataagacacgcccaccagcatgccatgtcagtttaccattaccatggcaacacctggaagttaccaccccttttcatggcaacaacctgtgagttgccacgcttttcctaaaaatttctgcataatctgccccttaatttgtatatgattaaaattggtataaatataagttcaaaactacctctgggcacattgcctatggaatagcccttctccacaagagcagtatctctgctgctgctgtccaattctacttcattacaagtttctagtgaacacctccagctcacccttgaattctttcctgggtgaaaccaagaaccctcctgggctaaaccccagtttgggggctcacctgtcctacattacttttacaacattcattcattcaaaaaatatttctttttttttttttgacatggagtcttgctctgttgcccaggatggagtgcagtggcacagtctcggctcactgcaaactcagcttcctgggttcaagctattctccttcctcagcctcccaggtagctgggattacaggcccccaccatcatgcccagctaatttttgtatttttagtagagacggggtttcaccatgttggccaggctggtctccaactcctgccctctggtgatccacccaccttggccacccaaagtgctgggattacagtcatgagccactgtgcccagactcagaaaatatttcttgagtgtgtaatatgttccaataattattctagcactgaggataaaggggtaaacaaaacagacaaaagtttggtccccatggagttttcattctagtctgagaagagagacagaaagtaaaatacaatattagatggtgataagcacttggagaaaattaagtgggaaaggtagacagcaagtttaatatgctcggagaagatcactctgaaatacaatatttgagcaaagatctaatagaagcgaggaagcaggccatggagttaatttggacaagagcatttcagacagacaggagatggcgaagagtaagaaaaagagttcaaggatcagtatggaggccggtgtgggaagagcaagaggagaacagtagcagatgaataaaaggaaatgggggtcagagacgtaactgcagtgaagagtagtggacagttgtgtagggaagctcttttgatggttgagatgggaagctgttgaagggtattaagccaagaagtgaaaacaattttattctacagattctggcaaaagtaactagaaaggttgggtaaagtggccattaactgagatgggtaaaactttaaaaggaatatattttgtagaggaatggggaaggaaatgaataatttgttttggaacatgttaaatttgaaatacggggaggggccaagatggccaaataaaaacagctctggtctgcagctcctagcaagaccaatgcagaaggcgggtgatttctgcatttgcaactgaggtacccagttcatctcattgggactggttatgcagtgggtgcgacccatggagagagagcagaagcagggtggggcgtcgcttcaactgggaagtgcatggagcagagggacgtccctcctccagccaagtgaagcggtaagggactgtgctacctacccggggtactacacttttcccacggattttttgcaatccacagatcaggagattccctcctgagcctacactatcagggccctgggtttcaggcacaaaacttggcggctgtttgagcaggaactgagctgcaggagtttgttcatactccagcagtgtgtggaatgccagtgagacaggagaaccatccactgccctggaaagggggctgaagccagggagccaagtggtctcgctcagcaggtcccacttccatggagcccagcaagctaaaaaccactggctttaaattctcactgccattacaacagtctggagtctgctttgggatgatcagtttggttcatggaggggcagctgccattactgtggctttagaaagcggttttcccctaacagccctaaggagactgggaggtttggactagacggaattcaccaaggtgcagcaaagcgactgtggccagggtgcttctctagattcctcctcattgggaaaggcatctttgcaggaaatacagca

SEQ ID NO: 15 - DNA, 70034 bp, Homo sapiens
gttggtcaggctggtctcaaactcctgacctcaggtgatccacccaccttggcctcccaaagtactgggattacaggcgtgagccaccatgcccggccacgcccagctaatttttgtattttcagtagacacagggtttcaccatggtggtcaggctggtcttgaactcctgacctcaggtgatccacccaccttggcctcccaaagtgctgggattataggtgtgagtcagcacccgttcagctgactcctatgcatttttcaacactcagaatatctctccccatcccctcaagaacccacaaatgggctaatcccacccacttcacactatttgcattttcatggtaacattttctcacctctatcacaactaacccacaccactttgtatatctgtgataaccaacccacatcatttatgtgtctgcccccactctaagacattggaaggtcttggggtcagagactcttgagatttactgttacatcctcaaagcctaacatacaataaaatgcaaatttccggcctgtggggtggctcacacctgtaatcccagcactttgggaggctgagatggggggattacttgaggtcaggagtttgagaccagcctggataacatggtgaaaccccatctctactaaaaatacaaaaattagctggacatggcagtgggcaactataatcccagctacttgggaggctgaggcaggagaatcgcttgaacctgggaggcagaggttatggtgagccaagactgtgccactgagctccagcctggatgaaagagggagactcctcttcaaaaaaaaaaaaaaaaaaaagtaaattaccattagcaatcgcataaaaaaataccaggcatggaggaattaatgtaacaagagatatgtaaaatatctacgtggaaactaaaaacctcagcacgatcttgggaaactcaacaagctgattccaaaattgataaggaaatgcaaagaaccaagatcctcccgaaaacaaaacaaaacaaagaaaaccaagtgggaagatgtgctttaccacatatcagcttcttagagtcactggagcagtctggtgtcagcacaaggataaacaaagaaaccagtgggatagaatagaaagttcagaaacagatctattcagatatgcacactcaatttatgacagagatggtgctgtggagcacagaaaaaacaggtttaaaacaagcattacaaataaaaaatattaaatttaaactaaaaatttaccttcctcaaaagacatcattttgagactaaaaagggaagctacataacagaacattttgcttgacacataattgacaaaggacttgcattcataatatgcaaagaattacaaaagaaaacaataagcaaaggacaacgtaagggaaaactggggaaaagacttgagcaattcatcaaaaaggaaatctaaaaaggcccccaaaatacgaaaaagtactcaaccttattggcaattagggaaatgcaagttaaaaaccccactagaatggttaaaattaaaagtctgacaataccaatcataggctgggagacagggcaacaggacccagattgctattaggcaagtaaggtgctgcaatcaccttgaaaaacagtttggagttacctaagaaagttgaagatacgtagccctgtggcccagcaattcaagggaaatatgtacaggtggtgaccaggaaggcaagtgcaaaaatgttgacagcagcatgattcaccatacctatggctccaaaatgaaactttaatgttcataaattcaatgttcataagtactaggatgattaaatcatattctattcataggacaattctatactgcaatgaaaatgaaataactgtagcctcacgagaacgtaattgaatctcacaatgttaaggagaaaaagctagtcacaaaagaatatctaggctgggcatggtggctcatgcctgtaatcccagcactttgggaggctgaggtggatgggtcatttgaggccaggggtccaaggccaccaaaatggtgaaaccctgtctctactaaaaatacaaaaactagctgggcatggtggtgcatgcctgtaatcccagctactcaggaagctgaggcagaagaatcgtgtgaacccagtaggcagaggttgcagtgagccgagattgtgccactgcactcaagcctgggtgacagagagaggctctatctcaaaaaagaaaaaaaaaaggaaaaaaaaatctaatacttgattattttatgcaatttatatagcattcaagaacaggcagaactagactacagttttcaggaattcatagttaggtggtcaaagaaagaaaagaaagtgactacattaaagtcaggaaaatgattacctttggggctagtgagacagctgtgaatgaaagggcatgtgagggtcttctgggatgtggacaagcttatatttctggatagtggttaaatggttgtatttcataatagtatgtggagctgtacaattgtgtttttatgtacttaacattattattattagttacctccttatgttcatagcagcatattatactcagggatgggtgacaagcaaattataaggattgaatgccttgggactcttaactgtaaataatcaaaaacacaacccaaactggcttaagccaaaaaaggtaatctattgggtaatataaattaaagagtgaggaggtcagcatgctggcttcagataaggcttagagctcttacactgtgaccaggtcctggtttcttttttgtctcaggttctctttcttctgttggctaaatcttcagttggttctttccttttgtatcccagatagctgccagtaaattcctgggattacaggtttccttttttaggtctagcagaaaagagaaactttgctcttcccatagctcagtcaaaacctctgatgtttagtcctacctctgattggcccaatgtggctcacgggtccttccctggactaagcactaagggagaaaggataaactggtggagcccattcctggtcaatggccaacagaccacctgtttattcaaggttcaagttggtattagaaagaagaagaggagaagaatagcgaggaggtagctaacaaatgtctatgacaatcaatgtccattttatttagttgaatatcatcacacataaacaacaacacacagttttgcactactccctacctcaggcttaatcagaaccaaggcaaagaaagtagctggatagaacagaggtgccagttgagctaaaatctgaaaacaacagcaaaaatataatttgtttctgctgatgttagtgattctaaacagtcacaggtgctcagattgatgaaaagcaaagctggcttgtcagattggatcttctttagagatattttgaggtgaactgagaaaaatctgagtattgactgggcagtagaggatgtagagaactatactccattttcttaggtgcggtaacggtaattggtaaaatttttagaagcagcagcttggagtattcaggagtgaagtgtgttgatgtctgtagctctctaaaatagcttagcaaaagacacacacacatagataaagcaaacatgcaaaaattaccaattgttgaatctagatggtatgcatatgggtgatcactagaatattcttttaattctatatgtttgaaactcttaaaatgtggggaaataaaaaatgttttcagaaaaatctgaaaattccagacaaacaaaaaagctgacttatttctatgctttctcttcttatagtctcaggtattagttccataccagggagaaagaaatacatttattttggtgttaaaacaatataagttctattgctgttttcagttatccacgaaaagtgtttattcagcaccagctatgcgtatgaatcacttagtgttaatataaagttacaatttcatctttatctccctattagagaataaaagttgacaatcaaatactacagacagaaggaagggaactaggccaggtgctgtggctcatgcctgtaatcccagcactttgggaggccgaggcatgtggatcacttgagcccagaccagcctgggcaacatggcaatatcttgtctcaacacaaaaattagctggtgtggtggcgtatgcctgtagtcctagctgctcaggaggctgaggtgggaggactgcttgaccctgtctcgaggaaaaaaaaaaaaaaagaaggagggggaactattgaggactttgtaccaagaatattagcacacatcacttcatttatttttcacaacaaccccgcaaagtagatattatcactatccctattttacagacaataaatggaggtgttcttaagttacgtacacttggcacagggtcccatagctagcagataggaagcatctgaatagaagagtaaatctctcatatactgctggtgggaatgtaaaatgatgcagccactttggaagactatctggcagttcctcaaaaagtgaaaccatagagttactatatgacccagtaattctaccaagacaaatgaaaatgtgtccacacaacaacttgtacatgaatgttcataacagcactattcataaatgccaaaaagtggaaataactcaagtgtccatcaactgatgaatgaataagcaaaacacggtatatctatctacacaatggaattttatctggcaagaaaagaaaattaagtaccaatacatgctacacatgcatggacctcaaaaatgttaagtaaagtaagccagacacaaaatgctacatattgtatgattctctttatatgacaagtccagaacatgcaaatctgacagaaagattagtgactgcagaacaattaatgattgctgagggctgggacgagaaggtaagcaactgctaatggatatgggtttttttttccccggcgggaggttatgatgaaatgttctgaaattgattgtggtgatggttacacaactctgaggatatactaaaaaccactgagttgtacactttaaaacaggtggattatatgtcaattaagctgtatatatatatatatatatatatatatatatatatatatatatgaaaaaaagagtgaaccgccctttaccgaataatgttgcctaacaaaactatagttttccttatagagttggctctcaaaatcaaaccatgagggtagccaggttgaatggattctatatattatctagactcttctaattagggagttgattattgaattggatatctttgaatatctggttgtttgaattggataaagaaaacctcaaagtgcccagaaaacattaggaacaagaaagtgtgtgaagaaatgaagacatgaaaattctccctcatattcccaatgctggctatccaaggttctttggattttggccccaacatgtgaaatccgttatatcattttctctagatttagaaggcagtgcataataaagtggccatcagttcctgcggatttgcaacacaagactatttctatgtgactattagcaatagttggctctatcaggaattcaggaacgagtcttttggaatggctagaactggaacatatatgcactctttcaaactttgtgctgacttcctcctcaatgttggatgcatttagacaggaaggaagataacctttcgaatcctgaatggtctgccattgggcagtcataaacataccacttctttccttctagcaccctgggtaagttccttttatgaccaagctgtggcatttagacatttccttatgtttcttccaggtacttaaggacaaatttagctcctggcttttcctgatttgggtgggtttgggtgcctctagaaagtacttcctctacacttgattgagctcttttatttgagctgctctcgattcacccaccccacccccacttcttttttcttttgcgttgctttttagttctgtttaattacctgcttctggcaatgtggagctttcccataactggattagcagcactataatagcagtaaccctttcattaccagagtaattttctttacttgttttgaacttcagcatttacaggcagctgctattaagttaaaaggtaaaaagacatgtgactttttcctgcttttacaagtccagaatacttccagtgagggttacagggctttgaagccattttctccactttaaaaaaaggaaaggtaagagctgaagtaggcctctcctccatttaaaacacaaatccagttagagaccagcctgaccaacatgaagaaaccccatctctactaaaaatacaaaattagccaggtgtggtggtgcatgcctgtaatcccagctacttgggaggctgaggcaggagaattgctcgaacccaggaggcggaggttgcgatgagccaagatcacgccactgcactccagcctgggcaacaagagtggactccgtctcaaaaaacaaacaaacaaacaaacaaaaaccacgcaaatccagcaaccatacttccttttagaatcacattttcaggattctgccatttatccaagaataataaataaataaagttagaatttagtgttacgttcattttgacttctttgtaatctgtttctggccttaggttttcttgactcagtcagatgtaaagttgttaaaacagggaggggatcaagataaggccttgctatcttggtccatttcctattccagtcattattcatgtgacctctgtaatttttttacttaccaggctagattaagagactcatgaactgcatccctgggatgtgacaggatttatgactatggtgaagtagtctgaggcacctggatgaaaggtggttatagtgagttatgtacacaattcccacacattttaaacacttgattcctacagagctatcaaactaatggaaggcaagttactcagagtttggttgactgatacctccagggattgcattttctaaatacagagcttgctttcacaatttcagcaggatacaagagtgttcagaattgggggtttaccattcaaagggcagaggccagagacttgaatttacaaggagggtcctcaacacagacatcgagattacagtacattaatttctcttgcacatgaagaagttgaggcttcacaatttcagcatgacccagtatagttgcaacatcttacccatcactgggtgtgtatcttctgtgtacactggccctttcaacatctaaggccaggctaggtgctcatagcaactggctccccaggaactaacgaaagagaaagcaagaaacagtggaggggttttggtgatggtggaaggcaggggagatagaagtgggggttgcagaaggtcgtggtgaggcagagtggcagacaaatggggaatgagaagtcttgccaagcccagaagactatcgttgtgtaaacacacaatatgcttcaggctatgtattctgggcaacagttcctgccctaaaaggtgtggacatttaaattagggtaggattgcgcattctgtgatagagactggcacagagacaaagtggaactcctctacgttggggaggggaaaacatacattagcctgttttgaaccttagaccaagacaagacaaacacacaaacaccatttaatttcatactgcaataaaattctttgtaccaaaccatgggatcaaaattgttacagatactcagtgaacagttccaatgcattcattcatccagtcacttactccacaggggtttgagtgcctgcacttggtgctgggcacggctgagccatcccagacgccaaggagtttacagtctagtccagtcagtgacgaggttaaaacgaattctcgcatcattgctactgcgaatgcaccgggacaggatcagcccttcaaattctcccacgtggtccctgcaggtgagtgtgggtgtgagcgcttgcggcccgtggtgtttgggagtgagagagcacgtgtgtcagaatggcgcctgtcacagtgcgcgtccaggtgtctctgcagtacgcctctccatagccacccgagccgggctgtatgggcttggctaggcttatgtctcccgcccacgcaccgaaggcggtgcggaaagcactccgcgggcgcgattgtgagtgagcgcgggcgcgcgcgggaggggcgcgccgcgctggctgggccgcgcgcaggcgcagagtgcggaagtcgggccgcggccgccgcagagcgccgggggcgggaggagcaaacgcaggaggccatggccgccgccgccgccgccgccgacgccggcgccggctgctaaggggctcggcccgcgagcgcctgctgccgcggacgatggtgaccgtacgggccgggccgctgccgctgccgctgcctccgcctccccagaagcaacatccgaggctcggcgcagaagagccgccgctgtgagccgtgccgtaccggcccccgccgccgcccgaggagaacgggagggcgggcgagagagccggggagttgcggagcccgcccgccggcagcgccgctccccagggagggagtccgcagcctgaggtgaccacgccgcccgcccggccccttcccatccccgcgccccccggccgcttcccacggcctccctcccctcccccatcgcgtcgcaggctccttcctcttctccctgttcgcccctttccttttatctcgcttcacctccctcttctccctagcattggaggagtccacatcccctcttcagccgcagcacccctccctcccatcctctagctcttcccgcggtggtcgcctccctccgaccctgctctcccctcctgggccccgcgcaaagccccctctgttccagctcccgggcctcggctgcctccccgccctcccatcccttcctcttcccagggcctggagcgctcccttacattcctgagatgcccttcctcggggctgtccccctttgcctccccagcatcccatttctaggcctttttcaagacccttccagagcggcccctttccagctccctttctcgtttccatttccaactttgcctcttttgcctctttgttcactttgcttccaagctcccctccctctttcccttcgtcttaccctgctttgatctacgcagccccaaactcaagctccccgctttcaggtggtgcgaggttgtttgggggtgcggaagggcctgccagtccatttttcgaggggggcccattgctctgcatcccgtccgtcagtcccttttatagtaagagggctcctcatcccttcctttttgtccccgtggtttcctctgtcttgccatcccttctgtcttctccctccaatactgctttccccacccaaggaccctcagacccgtgaaccccccttctggaatgagttccctttctgttcggggatgctgaacttcgcccgcgtttttcttcgcgagccttttggtacgtggcgtggcgcgacagagtcagcacccttggcgagataggaggggagctctcgagcctctttcctggaagagtttttgctgaacgtaatctcttagccccgcggcggcggcggcccggttgctgctgctactgctgctgcgctgcctgcttgccgcgagctgggttggggttactgtagttcaaacgcatctgagatctgcaggcgttgtgggaggaggtgcggggagagaggaaggggcctgtgcagtgagcaggcatcaaagattagtggatggccttgcgtcgcagtctgcagtaaagaggaaactagtctgaaagggaaggagaggactgtgtgtctttttattttttaaaatacggagtgtgcagttttactgaatcttgaatcatgcccaaaagaatgagctgtcggtgctgcagtcgtgacccaggctgagcggccgatggcagaggtagcagttttatttcctctctctgttccttaagttgaaagatggcctttgtattcagagtagactccctgtctttgcggtttgggagatgatgagaaaccacagaattgctagtagtttatgtggagatcaggtacatacaaagttagctagcaaggagtgggagtggggaggaccagctatatttaaaacatgtgccattgcttatgtaagaaatgcgttctctttcctggtatctcagttctgggcttttacttagaattttaggctctagctttgtgctcttaacattttcagtgaggcctaccatcctaaccgatggacagcccgaaaatttacttttcttaagatcagttttagttgatggtagaatttttttttttaactggttgggagaaagaaaggagataatggtgaatgatgatttttgtttttcttttttagggggaaggtgtagaagtattgtactgaatagttttaagttgggtcacgtgtcattcttgttttttctttgtctttttaaaaaaaagtttaggaggtgtatttttgaagaactcaaataagagaaataaaaaatcacatttttcatttctcttatttgacatagttcttcagagattagctgtgactgtaaaaacctacatttttcttattcaggacgatttgtttggtttcttcatattcaaaactaaaatcccgtattttcaggaaagtgtagaatgaagccccctgtgttttctaacccacaaatttgaatggtaaactgtacagcattatacttctacaagacattactgttttcataattacggattgctgcttctaagcctgagaaggtcatttaatgaactcattgaggtctcctttttggttagcatttgttgcacctcttgtggtttttggaaagaaatgccttttttttttttggtttgtttttagctgttttactgtgtaaaacatctttgagtcacatttagtttatgttacctgcagacacatcatgttggatattactttcccagttcttttcaaagttcaaggaggacattttaaaatcttgcatggaagataaaacagtataggaagtttatgtatttggctttgggtgtgttaaacctttcggttttttctgctttcagctctcctgcttattttctaggattatttggtattattttgttttcaagagaatattgagctcccctgtactttaggatatgctgattagccctgtttgacaataaatctggaacaggataaattaggcaacattataaaggtattctctagatcaggagagaaggctccattttacttcgtgtttgtatgatatagtgatttggcaggtgtgagtaattgcaagtacttgcaaagaagatgaatattttaaagttttgttttgatgttggtttagtgtgtggtgctaaagtgtagtgtaaagtacctatttgtattgataactatcatgtgctcttttactttagaagggttcaaagtgataaggttttgaaatttttttctctttgattttccatgtattaaatttgtttcgtcagtgcctttatacatgaccagcttgccactgacttgctaaaataacattcacgtatagaaataaatgcaacatttagtttcgtttatttgggcgtatttaattctatccaaagtccttgttaaaaacatttcagtctcgagttgactatgtagtagagggggatcttggatattgttttttattgacagctttcgggacccggtattttctctttatagaaatagaaatgtgtcctgttttctgtttcttattatatttgttaggcaggagtggtgggtggaaataaagagggaacatgtaccattctgctaatggacttttgtaatagagatgatcctctgtacggattagggagtttttcttccctagcagatcttgatttctaaagcaggattagttatttgtttagtttaaattttcttctttacccgtttaggagccacagtaaatggtgaaaatgggcacattttaaaatagcaaagcattgaaaaaagagaaaggttccaaatcaaatgaaataaatatgggctacaagtgttaaatcagtaatagctcctccctctcttgttacttataaaaacagagtaatgatttatattggattccagaatatagaaaaatagttacttttcgatggcagtataaagactgtcagtaatactgtcatctcagtacgtggtgattttcaaatatggtggctggtggtttgtgagaagatctattcaatattactttgaaataaattcccaagagggtattgggttatcagtttgctcaccaaagtaagtctttccactgtaattcctgaagttatctagatggcttatacacattaaaatgcattaaactctttaccaacaatttctgtgaatgttttggtgtattttttcctgggattagaaaaaataataatatcatgggctttgagaaatttagattcctcagtggttggtttgcaataaatattaaaggttagagattttatttttcagtgcatttttccttcttaggacatgatatttagttctgattttcacaataatattttttcttatgtaggaaaattatgaaaatgatcttgttcatgtgaaataatcagaattgcagtacttatctataaaaatgttaaatctatattattggcaggctatatatataaaacatttgggttatgggaatggttgatatatgattattgaaaagcttttattgatagtgtgccaagttgggttgcctttagctttttgactatctgaactaggaagctatgaaaattggagggtaagatggaaatactgacaaatatttaaccatagcatagcaatctgtcactataattttctgcagaaataaatgttttcgtttgtcctgtaatgtctgaaattactgctaaagctggaaatgtgtttagctttctcagcaaaattcttaaaaggatattgtcagagccaacaatccagaattatctttactctttaaattgttctttacccacttttgtttgccttttttttttttttttttttttttgagacggagtctagctcagttgcctaggctggagtgcagtattgtgatctctgctcactgcaacctctgcatcccaggttcaagcaattcttctgccctagcctcctgagtagctgggactacaggtgtgcaccaccatgcccggctaatttttgtatttttagtacagacggagtttcaccatattggctaggctggtctcgaactcgtgacctcatgatctgcctgcttcggcttcccaaagtgctgggattacaggcgtgtgccactgcgcccggccttgtttgccctattttatatttttttggattaatttgaagttctaccatataaagcagtatggcattgaattgtccctttaaatagtaaattgtcctgataactgcctttcatttcctcctccccctgcccccccccactacttatcatggtctgtgcagagacaggggctgcagactcaatgcctggcgtcttccatgtgcctgcttatctgtgtatcaagggaagaatttgatgaacacttgaaggcagattatgggaattttagaccatatttaactttaaagattcaaggaaatgatattgtaaataatgttccctctacctgtatctacatcatgagttctctggattgtaaatttagcacttcaattttgattgtaagtgaataaggaaaagcatagagtacaagatgctgcaaactaaacgtgcagttatcaagtttttattgaattgcttaggctttttcatagagtaaatattcaaaattcaccctcttatgagctacataaatcatagttttattggagtgagtgaatttttcaagttaattttatacaagttacagtagtcttacagagtgttttgttcctagatttggagttagtggccttttaaaaaattagttttgaggccagaacatttaatcagaattataagattggacagaactgaatgggtcaatgtgaaaacacaatacagaggttattttatgaatatctaaaaatagtagttgtggctgagaagtagtatacgttctcacatagttttgtacagtgtgtgacaacctattagattcgtgaaagggtatctaaaagcgatttgtgttgactttttatttttatatattgtgtcttctgaattttaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggtgagtgtctacatcacattttctaatcttctagtgagcattctgatttatgtcttagtatctttttgaatttgggtaaaatgaagttcattttcattaagatgatagtgatatagttattgatgagtgtttatgaatcttgatagttttgtcttatcattgcacatgaattattaaggctacaagaaagtaagcagtattggatttattttactggataaaactggaaggcagaagaaaacattctagattttaatatgatgaaatataaacaatgagaaatacttttagagacatttggccccttctaatttgtccttgttttggggtttggtagtaattcagaaagtaagctttttaaaatgcaacattctttattgttccctgagataaacgaaaacattaacatcagctgaagataaagtgttcagttaaatgaaatttgggaaatgatactataatactttgttccataaaaaaaatcctcctggaactataattttttttttttttgcttgaatcccctttcaagaaaaatggaactatcattgatatgctatggggttagtggtaaaaataatgataagagattgaagaaattaaagtcaagaaatacaagcatgaaacagataaaatttacctagaataaaaatcatgatccttactttttaggttttggtttatttgtaatgtatatagcaatatattttattaatgttgtgattgcagagttccagacatggtttgaatggtactatagtggttttgctaatattttattattagagttgcctgtcacaaaatatatcttttataaagtcatgaagagttgtcctgtctctctgagatttatttttatcactttctgggttctaaaacttagccctgagaacgttccccttacatccctaagaggtaagctgttgtggaaagaagtatgatgtagtagaagagatggtgcactagaaacaaaacgtttcggttcagtaaactcatcttttgtggatagcactaccttgggaatgtctctgaaatgggaaagttcctttatgttgcaaaacactgtaattctcagccttttatgaaaggctttgtatgttagccaatttatggaaagtaattcccgtcagttgtagaacaactgggtacttggcttagatttttagattaatcagcaaagtcatacatactgtggttttaaaaatgtgcttatatattgtttctgaataggttgaaatatttattataaaaacagctgcctgataaccaggaatattaattttagaaattgaatgttttcgagtacaattgaagttcataatctggtttataattttataaagttagttgagccatcttaaatatgcttactccatgccaaagtagagtaagctcagtggttgcatgaacagatattttcagcttgaacaatgttttggttggagttacctttgtcaaaatattacatagtgtttatgtaatgctcctgtttacagaatttcaccctcaaatacaaatcaaatttcaccttaataaaataatgtatctacattcagaaataaaaaagcataaaaagtatttaatgaaaagtatctccctcccatctctgttactcattcgctgagttctcactctgaacaccatgtagcttttatttctttctgtataattctagagatatttttatgtatatataagtaaatataaaaaatgtatatttcccccctttttatacagatgttagcatggtatacatggttttgaatcatggtttttgtttgtgatgtatgtggagccataactactgcttttagatatttatgaaatagagttttgtgctctttttcttatgatgacagtctgccggatcttaaagactctcttgagtagatatcgaggcctcatttctcctcttcccgattgcattttacgttggcatagtatcttcgtatggatataccataatttattgaactaattactccattggtggacattttagatagcctaccttctgctattttgtacagcgttgtgctaaataactttgtatagctataatttcaacaagtacaaatataacctggggctaagttactagaagcgaagttgctgggttaaagagtacagtggtccgtcggtgtatgctggaagttggttccaggatgcccacgtataccaaaatctgcgcatactcaggtccctcaagtgaccctgtggaactatgtatgcagaaggttggccctctgtatacgtgggttttgcatgttgcaaatactgtattccataagagtttggttgtaaaaaatctacatgtaagtggaccctcacagttccatcctatgttgttcaagggttaacttatatatatttgtagtgttgacagatagtactttccatagggttttactattttgtacctccaaaaaccgtggttgagagttcctacaatcctatattatcaaaacagcctgttaccacaaatattttggctactccaataggtggaaaaattgatttttttaactcaatgtagttttagtttgcatttctattatgaatgaattgaacatacacatacttaagaaaaacctgtattttctcttctgagagttgtcagtttatataccctgcccacttttctgtgagattctttttttaccaatttgtgggaatttggtatacattagggaaattaatcctttgtgataagttgaaaatagtttttccagtttcaactcagtgattttgcttatgattttttgacatttagaaggtttttaagctttagtattttgagtcaattagaaaagccttctttattcttgagtttataaagaattctgttgtattttatcttactatttttgtgggtttatttttacatttaaatctttgcttcatttatctgtatgaatagtgtgttataggtataattttattttttctagataaccacacagtcatcctcacctatttagtccatttttttctcattatatactgaattctcacatatattttgtttcatttttgaacttctcttcctttagtctgtctgcctgtttgtgaactattaacacgctgtcttatttgttgagggtttagattatattttactgtctaacagggttagtcccttcagttttctttatttcctcctctgagctttttttttatggttagttttctatgtgaatttaagaattgtctcaaaattgtctaggtctcattccaaaaacaaagcaacccatttgattttttttaaaatttagattgcattattactaattttgggggcaggtggggaggatgggttcttgctgtgttgcccaggctggcctggaactcctgggctcaagtgatcctcctgccgcagcctcctgacatttattgtttctaggtattttatcttttttattgctatcgtaagtgggagtttttccccctttatgtcttctaattgtaattaaggagcttaaaaattaagggagggagcaataaagtttgtatttaatggaatgtaattgtgtcttcaaacttagaagctttccagggtgggttctgctgaaagagaagtgactgcccactgttttttggagtgtaggatatgaaaggaggagtagaagtaatattggtaaggtagaatagggcttttgtgaagaatcctgaatacatacagtagatatggtgcttaattctataggtcgtggtgggtcagtggggattttagagcaggtgagctgcattttaagattgattaggcagcgttttataggatgatggattggggaggggagaaactggaggtaagaagaccagttaggattttaggcaagaggtaatgagagccagaactggcaaggtagaaattagaaaggaagaaatggatgcgaaaatccttttgaaactaccatcactaaaatcattagtgacttaaaatgtaaaattcaaccctcatttatgtcctaattctacagacttttctatgtttatggagctgtttaccacttcctctttcttgaaagtgtttttttttttttcctgatttttctcctaactccctgaccattgcttctgattcttttgatttgttttctttagacttctcaagtgttgatattgcccacaatttgtgtttaattttaatcttttgttgtttgggtgaccgaacgtagtttgggctgcagatctctgtctccactttacattgctttttgaccactgtagtctggagttgatgttcttcctctgtgattccatggaaccagttcacatctctaccatagcaattattatgttgcattctaagggtccatatgcttatctattttcccaactgttaatagattgtgagctcctttaaggtaagaagggggttgtttattatctcagtattcccagcacctagctggtgcccaataatgaatgaattttatatatatgtatgtatgtacgtgacagggtctcactcttgcgcaggttggagtgcagtggtgtgatcatggctcactgcagtctcagactcctgggctcaagtaacccttagctgctggagtagctggtactacaggcatataccaaggtcttgttttgttacccagactggtctcaaactcctggcctaaagtgatcctcctgcctcagcctcccagagtgctaggattacagatattagccactgtgcccagccctgaatgaatgcattttgaattacttcttagacatttccacctaaatagcctatggacatttcaatttgttgtcaatcactgaactcatcacctttttctcacctcagaagtctttctcctgctgtgtttcctgtcttaatagcaaagctgtcttcttgattacccaagctagaaacatcagatcttcacttccttgttctcaactagtcacccacagataaccactaagacctatttaaatatgtatctcatggctgactggcagctccatacccaaagctactgttacaatccaggctctcatcttacctctggtcctgctgtttaccctacaactaccataatgtttaaatagcagaaattattagattcatcagtgttgttttaagcaggtcatcattttgatttattttttattttttctgttctcagagtctgttcccgtaggtcattatttcttttatttatttatttatttatttatttatttatttagagatagagtctcactgtcgcccagattggagtgcagtggtacgatcttagctcactgcagcatcaaccttctgggctcgtgtgatcctcccacctcagcctcctcagtaggtgggaccacagttgtgtgccaccacacctggctaattttttgtatttttttgtagagacaggaatttgccgtgttacccaggctggtctcgaactcctaagctcaagtgatcttctgctttggcctcccaaagtgctgggattacagatgtgagccaacacatccaacccttattttttatagagacagggtcatgctctgtcacccagactggcaatcataacctcactgtaaccttgaattcttgggctcaagggatcctcccaccccagcctcccgagtagctgggattataggtgtgcactactacacctggcctaggtcatcatttttaaatgccactggtcttgctttttaattacaaattactgtgtataatttaaaaactaacagctttgccattgtcaacttagtttgttatggattgtttggttaatgctgtagagtgagttgtgatgcatgtttgtgtcaatagtatttttggcttgcattttttaaattgttagattatatatacatcgtagttcagatggttcattcatactgctctcatagttagtattcatcgtctctcaaagttttcttacacaaatattttgttatcacagagttacttttccactggaatataaaaatggggtatagatgagcaatggtgcttttgttgttttggtttctgttctcttacctcacctaaatagatattgaagaatttgagaaccattagctaagtctaaattcttgattattgtatttaggctttatattgaggctttagctgctagttctttcagcatcatctcccaatctttctgttaacatcaaagtctagtctaacgtacagaatttactgtcccctgaaaattacacttttatggttttcatgcttgctgttctcttttcctagaatgtttccttttcttcttagcctggtaaagaaccattcacctttagagatccaagtcaagcttaatcacttaaccatagcccttccaatgttcatttattatagcatcaattttgtctaataattacttttgtccatgcttatcttttcactagattattattcacattaattttggatcttccatgtctaggaatgcaagtgggtcatactttacacataataatgttgattgaatgactggataattgaaggaatggatgaaatgaatatgtttgatctagaagatttggccgctgattttatatgcgatatataggagaaagaaaagacaagaccgttctggaaaggaaaatgacagtttcgttaaaagagagtttaaggagaagtttcatgtaatagacattagaaaatccttcagctacaatcagtggaaatgcttagtaactatattacatatcctttaaaatacctctaaagtcatttgaggtaggggttaacaaaattggggaaattattttaagaaataaagagcaaataaaaatacttatctctggcttttgatggactgtccttgcagttaggatgtgtaggaaatcctcagttctgtttctttagtcccaagcatgctcatgttttcttagcttttggcatgattgattcagcatgagagaggcaataggggataagtaggagtacctgtgccttaataaagatttgtaaattaagtggaagatggttatagaagagtagactgggtccagattgtgtaagaccaagaatgtcaggttcataacttttagagcaggagaattgtcaagtaaaagtgatggtgttaggaatattaccctggtaattaagtatatcagggtgtccaatcttttggcttccctggaccacattaggaaaataattgtcttgggccacacataaaatatgctaacactagtgatagctgatgagcttaaaattgcaaaaaaaaaaaaaaaactcataatattttaagaaagtttatgaatttgtgttgggctgtattcaaagccatcctgggccacatgtagcccatgggccgtgggttggacaagcttgaagtatagggtatacaaaaatagagactgaaagaaggatggtagtatactgtgcattgcagagcagattaggatatgggacatagaggttggaatggaagggtaacacatgagaggaatttatcatggaaggctcagcaggacttgacgataagagagaaaagatgacaggttttgagtcactgagttactttgttgagggaggaggtggggagcacagtttgtacttgttgaatatgagaacatttaagtggaatatatctcaggtgtcatgagatgggatgtctacttagattaagaaatgaggatatgtttttgcctgtataataagttatcagtaactttgttgataacatttatagaagagatgctgatacttgaagttacaaaatatgttgtttgcactaggtactttatatatagagaaaaacagttgtttaggaaccaaatttccagtgtttattggaaagcgtgaaaagaaattagagaagttagagggtaagaggaaatccatatgaacagagccaaagagtaacaacgttttgatggtcgttgcctggatattggggatcaaaaataagcaggatgtcttagatgtgataagtaggcagtcgttgacttccaactttctttagagcaaacaagttaggggggtttgtaaagggattgtagatggtaaagagaagaatagatgcttagaaaatagaggcattgggtatagatcttttcaaacatttgacagtggaatgagaaaaataataggaaaaaaatcgcagtgaaaagaagtttattttttttttctcaagatgggtaaaagccctgcacattctttgaaacaaaggtaaggagtgatgtcagggggaacgactgaaagtataggagatagagagtcttcaggggttggagaaataaggtcttaaatcacatggaaggggcagccttggaaagagacattaagacacccagtttttcctctgggactagaaagaaagagagaattggcataaaacaagtaagttgatatcaaggaaaggtagatgaagaaaggagttgtgttacacatttgtgtgatatatttgattattaggtagagaaatctacaaaagaagtgaaaaacacaatacattttcaacaacaaaaaatccataggggtgtcactatgctaaacttactttggtaagtataataaaaaacctcagaaagtactgaaacctatttggaaaattatttgtctcaagctctttcttttattgtaattaattgggaaactaaattaaaattgtattttatttatctttctggtacaggttatatcttaagtgtggtgctgctaacattgcccaggcagcatctggttcagctttatctatattttttgactgctctgctcctctatgctggacatcaaatttccaggtaagaatatgaccccatttttgaaatgtatgattgaatttaaagttttcttttgccaataaaatacttttcatgaacactgttaagtaaagctaaggctttggtaggtccaaaactggtttgatactcattttccaaatcttacacaggattaatagctggtttatgctgacattttatttctgcttttaaaaacaagcttaacatgaaacaagccttaaggttatgtttataaagatatccttgaactggctgggcgtggtggctcacacctgtaatcccagcgctttgggaggcgggtggatcacctcaggtcaggagttcgggaccagcctggccaacatggtgaaacctcgtctctactaaaaatacaaaaattagccgggcatggtggcgggcgcctgtaatcccatctactcgggaggatatccttgaactttcctgtattgcctgataaaagaatttctaaaagtaggctgtaggagcattttaacaattatagacttcattactttaggaaatcaatttatgatgtgtaagaatcagcataagatgcagccatgtggagtgaatgattgatatacattatcttgtaaggttgattgtatagctaaccttctatctctttagccatattgtctgtgtacctaagtctgctagatctaaattttaagacttgggtctgccaatgaatatgagctttctactttgcaacagaatgttaaaatataggtggaccaaaagttacactatgaagtagtgggttggaatatattttggaggtataatttcttttgaaacttaaattttatgatttttgatagaaaggcatttaccatattaaaatatattcccaattctaagaggagtgaccttgcatatagtacaagccataataagagtctgaaacagattttggggtagttgaaatttaatcttagaagtagcatttttacattattagaattacattgttgagtttttaaaaacattaactttttctgattataaaattatggtgctcactatggacaatttttggaaaatacagaaaatgtaaaggcatttaataatcgtttgaaattataccacccagagatagatgtgttaatattctggtactttatttcagtttttaaaatactgttcaattctcaccacttctgtggatatgaaaggatgagaataactaaaatcactgggtttttcacccctcttgttgaaacaggaccaccaattctctttaatgttttgtctaattgtttctcaaagtcccagggtgtttcccagaagcttactcttcttgcattttcctcctttattccttcctggttgattttctatgctcaaaatggtgcctggaggatggtgtcttactctttaacttctgccaccatcctgcccagggtaggtcctctgatgtcaaagttgcaaaatctggagctggcagagtagtgttgcatttcttgcaatcctcacaatgtttaaatcaagctgtgttcccttcaagaatggagacagtgacattccccgttttgcatgacagaagtatgtcactgtgtcttagactccttcatgaaaacaacttagaccttgtcctgtagcatccctctccatagagccaaactaggagtccaagcaccaatactgatacagacatgatgcgtttctcatcctagtaccaccagcccccacacctctgttcctgtggccttaccccgatacctctgagtctcagctcaggctgaggatggagacactttcccatctttgcttactcttttgtaaacaaaaattgtatctatagagtgtaatgcagtcattagggtatactgagctctggagtaactgttctattttataaatgagtgcctgggcacttatttttcgatagatggatggtttggataggttcaaattccaggttttttatttactgctccataaccttgggtgtcatttcccagaaggataagccttagttttttcacattaaagtggtaataaaatatcttaaggggctgttgtaagatcaaataagataaggtatataaagctcttaccacagtttctgacatagtgagtacttggtgaattcttttgtcttgtttttatcacatagcaatgttttgtgagcattttctcattgttaatctttaaaaaatgatttttacatggtattttatgtatagccatataatatctttttagaattgataggattttgttgattaattaagaaaatatcaaggttgaaggtagacctcttaatattgttgcttttattatagctacaattctgggtgaaaaactgtgagcctgccctttctcatggtttttccatttccatttgcatttgtggtgtagtgatggctaaacccatgtagttctgtttttatctacagtgctatgctcccttggtatcatgagagtttgattctaggacctcctgaggataccaaaatctgtggatgctcaaatactgatagtatttgcatgcaacttttgcacactcccttccatgtactttaattcatctctggattattataatacctaatacaatgcaaatgctatgtaaatagtttttatactatattcttcagggaaaaatgacaaaaaaagtctgtacatgtttactccaattgcagtttttttttttttctgaatattttcgattcttggttggttgaatccacagatgtggaacccagtgaatatggagggctgactgtattaccaatccaggcatttctagagaggtcaggattctggtatataaggaaaaaggggacctaagtagtttcagaggtaaagaaaggattttttctgaccacccttgtggctttttgagctttttagtttcagtttatgaaaatgactttttctaatgtttcaagtttattttcataactaggaaattaaagcttattttaaataatagaattttgttttatttatttttattttatctcggctcactgcaacctctgcctcccaggctcaagtgattctcctgcctcagcctcctgagtagctgggactacaggcatgcgccaccatgcccagctaattttttgtatttttagtagagatggggttttaccatgttggccaggctggtcttgaactcctgacctcgtgatcttcccaccttggcctcccaaagtgctgagattacaggcacgaaccatcgtgtccagcctcaataataggattttattaagttttaataaaattttatagtaggcaaaaatacttcccattcttatttcattttgattttttttatgttcctttgggatttacagatgaaaaaaaggaagtaggcaaacagctaggaagggcaatcccagactttaacttgaatccatgttttcacaatctagttcattccacttaggtaggcagcatggttagtagaaaggaaaattaactttagaatcagacttgatacaaattgtttccttacctagtaaatatgttacctcagcaagttacttctttgaaattgtagactaagcttgtccaactcctgggctgcgtgtggcccaggatggctttgaatgcagcccaacaaaaattcgtgaactttcttaaaacatgagatattttttgccttttttttttttttttgctcatcagctattgtgtgttttatgtgtggcccaagacagttcttcttcttccagttaggctcagggaaaccgaaagattggatacccctttgtagacaatgccatctcatggagtttgttttgatataaaatgaatgaatttcaagatatggcatattttagtattaatattttcctcttagtataatttatactatatgatagtatctcacaaaaggctagtaaagatgtgctgtccttgaattattcataacatatcacagttaataaataccaatgtttgaatatgtaacatttgtaagacattgaggttgaaggttttagttttaaaaaaataatggttcagatttctgtggagcttcataaccaagtatcttttttttttttttttttttgagatggttgtcactgtgtcaccaaggttgcagtggagtggtgcagtcattgctcactgtagccttgaactcaagcacttctcccacctcagcctcttgaatagctgggactacaggtgtacgccaccatgcctagctaattaaaaaaatatttttttgtagagatgggtttcttgctgtgttgcccagactgatcttgaactcctgccctcaagatatcctcctgcctcagcctcccaaagctttgggattacaggtatgagtcactgtgcctggccccaggtatttttttttaaataacaactttatcgagatagtcacatacctgattaaagtatatagctcaagggccttgtatggtggctcacacttgtaatcccagcattttgggaggccaaggcaggcggattgcttgagctcaagagttggagaccagcctgggcaacatggtgaaaccccttctctacaaaaaattaactgggtgtggtggcatgcacttttagtcccagctacttcggaggctgaggtggaggatcgattgagcctgggaggttgaggctacagtgagctgggattgtgccactgcactccagcctggtgacagaacaagaccctgtttgacagaacaagctgtatatatgtatacagctcagtggtttgtagtacattcacagagttgtgcagaacatcatcaaaatttattttagattttcatcaccccagaaagaaacttcatacccattagcaatcattgtctatttcccaccaccctccctgcccccagcccttggcaactgtcagtctatcacctgtctttttttattgacctgttctggatattttatatgcactgaatttcacttagcatgttttcaagattcatgcatgttgcagcatgtgttggtgcttactttctttttctgtccatattccattgtatggatgtatgtcacattttgtttatacatccaattatcttttgatggacgcttggattgtttctatgttttagctattatgaataatgttatgacaattcatgtacaggttttgtgtagacaaatgttttattttccttggacaaatacctcggagtggaattgctgaatcatgtggtgcctatatttaaccttttgagaaactgccagactgttaaaatggctgcagtgtttcatatttctaccagcggtgtatgaggcttccaatttgtctacattcttgccagcatccattgttgtcctttttagtggagccattacagtgagtgtgaagaggtatttcattgtgctttagatttgcatttccctgatggctaatgaagttaaacatctttacatgtgttcattgaccgtgtgtaaatattggaaaaatgtttattcacatcctttgctcagtatttaattgggttatttgtctttttcttgctaagttgtaggagttctttatatattctagatacaagtcccttatcagatctatgatttgcaaatatatacaagtcccttatcagatctatgatttgcaaatatatacaagtcccttatcagatctatgatttgcaaatatatacaagtcccttatcagatctataatttacaaatatattcttccattcactgcaatctagttatatcaaggcatagtttattatgctcctgagaaggagaatcagcacttataataattttaacaattaatttcgtacttaaaaaactggctatatccagccttattggaaacaagaaaaaaaaatttaaaaactagcttatagaaaaagacatttgcaaatattaattttctaagttgaaaatttcatgaacttttgaaaagttgggtttctgttttcctttatgtgtatttacataatgaaacttattatcctgaaatgactaaaaacttgtttagaatatgtctatagaatggatatagcttgcagtttggaagaattaaatgtcagagattcatgggttcagtcaatgtcatataaatatttaatattgatattctaattgaacttaacagaatttggtaaatgtcagtttaaaatttttaaaattactaaactcttccttggcgttttgagggatgtagggaatgtatttttctagtgctaatccgtatagaaaattgagactatccaaaactaagggggaaaaaagaaaaaccatacactgatactactattcctgtgagagtgtggtggtcattcctgtgagggtgtggtcacatccacagatggatgttttttctaaaatttctaaactccagtatttcttttttttttttttgagacagagtcttgctctgttgcccaggctggagtgcagtggcacgatttcggctcatggctcactgcaagctccgcctcctgggttcacgccattctcctgcctcagcctcccgagtagctgggactacaggcgcctgccaccatgcccagctaattttttgtattttttttttagtagagatggggtttcaccatgttagccaggatggtctcagtctcctgaccttgtgatccgcccgccttggccttccaaagtgctgggataacaggcatgagccactgtgcctggcccagtgttcttaaattccttgttttattgttagatttatgaaccaacatattggatttgtgtgtctgtgacttgaattaagagcccagtagaactggctttcaaaagaaggaagtaatactgttttcattctggctcttcggtgtgtaagtacggtttcaaatgtaaaaacttccccaagagtgacttatgtgtaaactatggataatcagctctccattttatgatgacttgcataattcaaagttgtagattggggctgctctttctcagggatactagtattttgggcagggtatgcattgctacggaagctgtcctgtgcattataggatgttgacaacactctgtctacccactagaccccagtgataccctcttcccagcaaatatgacaaccaaaaagtgtccctagacattgtcacatgctgtctctgaggaacaaaactgtcctcagttaagaactactatagataggccgggagtggtggcacacgcctgtaatcccagcactttgggaggctgaggcgggtgaatcacaaggtcaggcattcgagaccagcctggccaacatagtgaaaccccgtatctactaaaaatacaaaaaattagccgggcatggtggcaggcacctataatctaagctactcaggatactgaggcaggagaatcgcttgaacctggaaggcagaggttgcagtgagctgagatcgtgccattccactccagcccaggcaacagtgtgagactatctcaaaaaaaaattttttttctttaaaaaaaaaaactagataaattgttttttgtttgtttgttttttgagatggagttttgctcttgttgcccaggctggagtgcaatggcgtgatcttggctcactgcaacctccacctcctgggttcaagtgattctcctgcctcagcctcccaaatagctgggattacaggtgcccaccaccacgcctggctaattttttgtatttttagtatagacaggctttcaccatgttggccaggctgttcttgaactcctgacctcaggtgatccgcccaccttggcctcccaaagtgctgggattacaggcatgagctaccacgcccaactgttttgtttttgttttgagacggagtcttgctctgttgcccaggctggagtgcaatggtgcaatcttggctcactgcaacctccgcctccagggctcaagtgattctcctgcctcagcctcccaagtagcttggattgttaaaatgagtattaccatttatattctaaacttaattttgacaggaataaaattgaccagtttcactgtttgacatgttttctgcttttgaacattatcaaatacaggcactcaatatctaggaggccagaaagaaactaaagaaagggtgtcaacagtttaaataaactctgggtaaatgaattattcaactgctagctcagtgctgacggtatggtaggtatgtttgtgtgcgtatatgtgtgtttagtaggcatataaggaaatacaggtatttgaacatctgagatttcttgtaccaagtggtgcttcttgttgcccatattgcaaaagataacttggcacacctcttttgtgtgaaaacaggttaggtttctttggaattaacgttgtttgaaagctttaagtaaatagccagaatgtacaagttgttcctaggttgtccagtgtctgagtcaggtcgctgaagagactgttataataaaggtctttaattagctgaagtggtaagctactaggttttgttcttggtacccatttattttttgtaacatgtatacttctctttataagcaagaatttttctaattgcaagctctgaggcccttttctttttctttctttctttcttttttgagacagggtctcactctgacccaggctggagtgcagtggtgcaatcttggctcactgcaacccctgcccctaccaggtccacacaattctcccacctcagcctcccaagtagccgggactataggcattaccacgcctggctaattgttgtattttttgttttgtagagtcggagtttcaccgtgttgtccaggctgctctcgaactcctgggctcaagtgagccgtctgcctcggcctcccaaagtgctgggattacaggcttgagctaccatgcccggaggcccttttcatagatcttgtacattccttgtggccccagtttgagttaaaagaggggaggctgttatacaggactagggacgtagatttttcagtttattagtgccttggggtgattatcagccttccacaagtgaaaaaacatttaagaaggaaaatattttattcagttataagtagattggcaggaattcttgtttctgaagatattaaaacattctaccttttaagtcttctgaaatgaaaaattgtaatgcttctcttgaatagctcacctgagtcttaagagaatcatatgttgttgttaaaagttagaattttatgactcttgccttgaactaatttttcacctaaaatgactcatggaattttggataattcccactttggatccttcttatttaggcttactgtcttgtttttcttatgttgtgaatgaccatccctgttaggactgatttaccaagaattctcaatgccagcatgagatacctggaatttgtgcataagtaagatatagagatttttgttaaccctgattcttatttcagttattctctacagtttgggatgggatgcccagatcctccttttagaagtgacagctccatagtggttgtgtggcatactaggtagtttagctgtcaccaaaactactgccttgactctggcatgctaagctgagctggcctaaagagagagtctgcaggctttctaggcctggctgtttttactgaggtggggctttttggtgagtcagccaaatggaggattttggaggactgtattgaaagagaggaatcgagcaaaggggaaacgttctaaggggcctagggatgatactaattttgaggctatgatgaatgatacagacttaaattgaacaggaatgtggggggcagtacagtattggagagctaatcctgggatcctagaggaggacaaagtaaggagagcgagtgggaggaaaccacttaacatcagggctgtcattgtggcctaaaggttgattatttattcttctggaatgcagacctcccttagggtcctataatcacagcaaatcgcaaagtaatgagtatagagaaagcaaaaataattaaaaagaaaataatggaaaggattacaaagttaagagaaggcttaaaaaaggaatgaaatatagggttggataaaagaaaaggaaatagttaaaaccttttataataaccatatgaaataggagaagtaaaataagtagtatttaagataaaaaagtaaaaggcagatagaaatattattagttaaatgaaaaagttagaacctagaaatagagaataaaagatgtagtttttaaatatgctgtgaatttaaaatctttttatgtatcaataaaaaagacgttaaaatcctcacagcattctgtattttttcttacagcactgatcatcatcataattaaataattataggactaagtatttatctcccctccctgtttataagttgcgtgctagtatggaatgtgcagtattagcagagtctagcagagtgccagcacttatgtattcagtaatttctttttgagttaaaaagcaacagagaatgttagttatccctagaaattttgttgtgtgaaattagaatttaaggtaagaaactctaaagaaagacaaagtttttaaaaagaggataaactaacgtaggctatgaaaaaatgcagaacaattaacaaatgtctcagcaatcaaattctagcataatgtttagtttgctgagctttattataaaatatcaataatatgtgacaaaaccaaacagtggaaagaaaacatggtagggacctcaattcttctgtcttttcttgtccctcacaaagagacacttgggactgaggcccttctggggcactttgtggctttctccttggggatagtgctcttggagctgacctctctcccttttctaatgtaaaattcgtataacataaaattaatcattttaaagtgagcagttcagtggcatatagtacattcataatgttgtgcagctgtcacctttatctaattctaaaacatttttgtcacccaaaacaaaactcagtactcattaagccgttactctcatctccccttctccccagcccctggcaaccaccaatctgtgttttgtctgtatggatttttcctggcccctgtttaaactgtatccattggagagagatatgctatgaccaaaaagaaattattgggctttaaaggtctggatagtactgacactcagagttgtatctcttttaggtataaatttatttttcaaatagcattttaaaatactttgtattaatactatttatatatgcattttgttctaatttcataattcttttaattttttagttttctaactatataattccattgatggttacctatagtaatcagatatttatgtgttatttgcatttgtgtctttctacatgaaaacagggttactcaatattgcacagttgacattttggactggatgattttttgttctaggggctagcctttgcattgaggaatatttagcagcatctttggcctttacacactaggtgctagtaatacctctccccaattgtgacaaccaaaaatgtttccagaggttgtagaatatcccctcaggagcaaaattgccccttggttgacaaccactgcattacaataattcttcctgagaatttggcttcctctttcagtagaaagagacaattaatacattatgtgttagaaaccatcatctaagagtgataaaggagaattgctagatcacccatataacttagtcatgcatttttataatctcagaaactgttttaattcttttaacaatttttagttttaagttttgattcttttttgcaaatacccttccggctgattgtgtgagggtctttccttgtttggctatgcagtgctaaaggaattccacttgattgcctaatgggaagtcatttcatggaaaaagtaaatacagccatatgagtttgtttggaaatacttgaaatgttctcttttaaatacaatgaataaagcattaaaagttgaaaaaaagggaagaatttttttacacaaacttcccttctttgatgccaaaaatactttagacaaactgtcttccagtactcccatgtaacttactgataataaactaaattctccctggttgtgcttcctgcctgttttctgagtgtgtaaaggctctggttattacttaaagcttactatttctcagtagtcacacgttaaatgagttaaattttaaaaggaatattttgtttgatgtaaaatttgcttcaaagtaaatatgtagcctacttaaatattataattatcttagatttcatatagagttgaaaatgataatttttaagggttgtactcctatcccccagttttctaactagtttgtggttctacttgggactaataaaatataatcggggccaaaactttgagggaaataagatgagggtggggtgatggtggtggaagatagccaaaagagatgtttagtgtaatatcactagatgtgattggttagtgtagtagagttgagagagatcagctctcaattgggtttttactgggcataaaatatttaataaggccatgaaaagaaagaaaatttcataatgtggagctttggcagctttctctgtatggtaaaattccatttcaataagttgtgtctgtttctagtgcacagaaaacagagatgaaggccatttatatataattcttcatatctaaatttttccttagatatggaaaggggtatcattaacataatatgcttttataagcatattgtgattccgctaggaatgtatctaatatatacattctaatcaattttcttatttagggactatgttcggagtgaactggagtttgcctatgagggaccaatgtatttagaacctctctctatgaatcggtttaccacagccttaataggtaagtattataaaagaattaaagtgtaggtaggaaccgaccagtcttactaacttataaaattcatgcatactcatttttttttaaaacggaattctcaaaagtgattcatggggacttttcccacatatacccattgtttagtggttttttttttttaagtcttcttttccccatgtatagattatgtatttatagtcatattgtacatagtgcacagttgcttgtgtttttttaagggttttttaagtatttgagaagattaatttttaaatagagctaattattactttgaaagattaaaatgaaacacgtagtatcttaaatttacttattgctgttgaaagccatgaccttattgtcaaaaatgaatgtccggaaacatcaagaacttgagatgtgattgaaatattcaggtagcagaatgttaaaaatagaagtgttggctaaggcctaaaaacaatatagatacaatttaaagtgaagtaccagacccctgctaccagagtgtaccatgccaaaatgcaaaaaaggaagtaagagaaaacctgttttgtgactttgaaactcacccatgtagaaggtgttaacaggcctaatattagagattagaggaggatttcttcagagagaactctttttttctgaaatacttccccagccctttacactagaggattcactgggggaccatttggggagttatgtgtcttgtgtggtgaaggggggaatgctgtggactggtgtctgactcaccctggaacatcttttttttttgagttacacttttatttttattttcttacattaaaaaactttttttttttttttgagacagagtcttgctctgtcgcccaggctgggaaaacattttttagataggtttctgggggaacacatggtgtttggttacatggacaagctctttagcagtgatttctgatattttggtgcatccgtcgcctgaggagtgtatactgtacccaatgtgcagtcttttatccttcacccacctctcacctttccaggaggccagaattccactatatcattcttgtgccttttcagcctgcaaaatctaaaactacattgtccaaaactagccacatgtggctggttagcacttgcagtgtggtgaattgagattaaggtgtgctgtatgtgtaaagcacatactcaattttgaagacttggtacaaaccaggttaacttttaatacatcttgttaacttttaatatagattgaatgtctatatgatgatgtttaggatatgttaggttatataaaatatattgttgatttcacttgtttctttttactttttgaaatgacactaatagaaaatttaaaattatatttggcttacattataattctaatctgatataaaggactagcaatagactagttgcttgttgagtgttttgactgtggaatgaaaatgccttatagggttttcctgtatcttctgatacaggaaattgtagagcaaaggatgtaagtttcttgtgaactagacagtggccccgaaagtctgtgtaggattttcttgggtcctgttcaagaaggccttttagatggatgagaagacctcaacagggattgaccttccagattcccaggagctgagaaaagagccaaaaatggccagttgagggtgtataccaagcaccaagggtactgctgcaggtgagagagccacagtgataggaacggtttcagaagaacccataaaagggtccaggggaaaataaatcagttttagatacctcaagtctaggaagcaccagtaacaaccacatcattgtaagagtccagttaagtaggaacctgcctacttccctccctctccttcttccctacccacttcaatccttggtaagtcagagagagagggagaagtgctaggtcaaaaaagagaaagaagccagccacaacctccccaccttctctcccacttgcaggttttctatcttaaagcataaaggtaaaaattaatgctttccctagaatgcctgaactctagagtaagggataagtctcaactttaaatctgtttgaaagtttcagttattattaaattgagacagtaacctaagctagagtagaaaagttatgggacttgccttggattttatctaggggcaggaaaaccactaatctctacagagtggattttaaaagacagcagaggacaaaaataatgttgctttatgactatcgttatgagttggcatatttattaacggtaacattcaataatgaagatatttgccaagttagaaagcttgtaaagttttagtttatgatgcatatacttgtattataaatatgaagcatatttcttaaaactcttcttatcagtggccatggtcttctgtttacttaactaagattcaactttccaaagtccataaactattaaggagcatgttttcttccaacttagattttaaaataattttctggtgtttttcttcatttcagtaacaaacttttttgaaaaactaggtaattttaatatgccatgatttcttagggttgccaacctcttggagatatttctaatagtggaatcctgaaatctaaagagtacattgggattttggtttatgcagagttaaaagttgaaataggcaaatcagaagacaaacaacttattcttttggaacttcaggggaaattccactaacaatatgactccttccttcttttacgtcagcaggagtagtcttctcttaaatacgccatatgagtcatattcttctatgaaagaagataaagggagcctgtaaccccagcactgagcaccacatgtgctggcatagacttaagggaattttcagagcttagaggaagtttacattgtgctcaacaaggacatttaaatttcatagctataaacacagtgaaagccagatcatttggtggcctcttgttttctatataattaggagtttttcttttctttatgcctttatgattatttttcacattactttagtatcagttttttaaaggccaaaattaatgctttgtgagataaaataccgtatgtgtttatgacatagtagattgttgtaagtgtttggtcttatgtaaaaatggttgacatttttgtatttttctaacacaaattgaattttccttattcaaaatgcttggcaccagaagtgttttggatttctgatttttttacattttggaatatctgcattatattactgtttggaaatccttaatcccaaaatctgaaatccaaaatactccaataagcattttcttggagcataatgttagattttagggcattttggattttagatttttggattaggaatattcaacatgtatatggatagaatacaaacaagtcccaaattttcattttggttttcattgacaagaagtgagagaatatgattaattattctaaattaatctggaaaataacattcagtaatctccaagaaattctgaaaggagcaatgagagaggacttgtccaatcagtatgatggagcagggtggtaccatcattagaatagatcactgaaaacaaaaagtaacaagttcttatatagacctaaatatgtaaaagattttggagtttactacagtggcatttcaaattaatgagaaaggaatggatgattccagtagccagttttgagataaccagctaaacatgtacaaaaaacaaacttcgatctttattttcttattccacaataaatcaaatgtattaatttttaagttaaaattaaaaattagctaaaaattactaaaagaaaatacagctatttgtataatcttgagtggggtagccatgtaataagccatggcactaaaggtgggtactattaagaaaaaaaatggtttgactattttcaatacatacttttataagagaataaagttatttaaaatattaagacaagggacatattagaaaaatgcaatcatgtgactaaggattactatttcgatcaggcagtaggatacgtattctagcagaaaaatgggcaaagaatgtgaacatttcaccaaataattgcaaatgttttcatatacttattgataatgttcagtgctgttagtaaccaacaaaatgccaatttaaaaaatttgggaaatattccctgttcttcccatctctaaattatactcactatggcaagttaatagaaaaatagccacattatacactggtaaattgttgctggagggcagtcttgacagtgtgtcaaagtctttaaaaatgtttttttctgattcagtaattcctagcctaagagaatattaggaaatgtgttccaagtagtttatacaaggatgtcataatgtaaaagcttattcatacaaagcattttataattatggaatatttggaaagggctaaatgcaaatatcatgtcacatacattcagtgtaccccagggtgttcttaggactacctttgggttgtgggattataagagactgagagtttcccattttgttctttgtatttctgtgtttaatgtaatgatcatgcgtaatccccagtgagaagaatttatttagtttttagttttaacttatgatttagttatttggggcagtttacttggccctccaaaaataaagattaaaaaattatcagaacaaatattgttgcagtatgatcttgaacaagtaattatatctcttggattttatgctttcacctatagaccagaacagttaaatattgcgtacctttggaaaagaagttatgtataaacattagcaactgaattgtcacaatactgaattagacattgtttaaagttttcttcatattacacatggcatcacagacgaccagtggagatttatgctgctctttccagatcagccctacagaattagtattcaaaattcacagaacatgtgaatatgtaattatagtcagatgaagtttaagtttgatttaaaatattatctacgagattttagttagacttcttcaaaagttgtgttattatccttatcaacagtgttttttgtttgtttttattttgtggatgccaaatactcaaaattaaatgtattctattccctattttaggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtaagactgctgacaaccacaaacaggtagataaaattctacataaatgttaagtacattaaagttatagttcatttttatttcacagttatggtaccattcatttttgcagtttcaaaacagctgctattttcagcccaattaggagcatctgaaagattcttgattatgttctattgagaaggcagtaaagtgaagtggttctcttaaagcagatttatctgagatcgaaccctgatgctgctgttcactagctgtgtaaccttgtgataattgcgttactttctgtaaaacggagctaataatgaaagctgtgctttcctcatagagttctgtgagatttaaatgagtttagtaccaggcagacagtgttccatatgtgttagctattgtaatgaagacaaaaataataaagaattgaatacctataagtcaaatcctgctttttccttctgattatagtcctactgtgactatagtttcttccctttgtgtgcctaatttaaacagaaaagttaaatagttctgggttataatatgatagatttcatttagatatagtacttgaattgactttgccaacataacatgctttttgtaaaagtttcttccctacttttttcagcctttgctctaagataaattactcccagatacaaacaatacacatttgggaaataaatgtttctgtttggtttaattgatagtttgtaatatataaaatagattttaacctgacattggtataaaaagagagtgttaaaatgtcactgtcttccacctcttgactgtgtccttaaggtacaggaagctctcagatagaacaaactgataacagctaagtgaagtattctcttgtggccccaggggcagatctttgagaatactttctctaagcttttggccttagcctgattctatcttcgtcttacacagtgattaactcgggcagttttcccaggagtagatcttccagaaaagggattatttctacagtcagtgaagagtggcttcatggggaagcagggcaggaagggttatagttgtattcagggtaataatgacaaatttaagatacatattttttctttgaattcagtcttatgagggttatctttgtttgtaataaataatgaatattcagtaaatacttattgaatattaaatatttattgaataacctcagccttcattttttaatgtcatgtttagttggttgccataagattcatacatcaactagatgtagttgttggaaatataggttataaaatgcgtgaccaggaaagaatcagataagcaagaaatggaaacagacaggtttttttagtggtctgtttcttgaatggaaaggaagaaaaatattctctgcctcgtaatgatgagtttacctgataataattttgcagctagttgggcagtttcctttttcttttaatcttttgtcactggggaaaatagaagttaatagactgggttgtagaaaaagcctttgctttactgatgaaagaattttaaatttagaataatctgcaagtcaatttattttaacttaatacttaaagatgtttataccttattgaaacattctggtatcacattgagagattccagcaagaccagctgactgctagatactggttttgtaagctgtccagcagaattcctgctgtgtcaccagggtctggtccctgacatagtaactctagaaacttggttacacctatgctcttagattgaatcagattctgtgattgatttttcctaatcagtttcataagaagagtgttttataaactggaaaactaatttagtgagttgcagattattaagccttttttttttttaagatatatccttttcctagtgttacttacacttggcaaaccaaatggaaaaacatagcttgataaaaacacagtaggaggaaggggaattgatgtgtatgggagaaaaagacttgctaactatctttgctctgcaaaatttttttccagtgattaagtactcttcttccattgaactgtttctcatttgtgacatttctgaataaaccctgaaagtttttacttttgcattttttttcctagtgcctcaagcagtgttgtatcaattcatgctagtcctgattattttgattagacatgagtgtttaccaagtctcctcaaactaccttttaaggttattttgtactgaatatgaccttattttgaccttatccctgaactattagggcagtttactgtgctattagataagtgtgtgtcaagtgttaataataatgcaaaattagtaagttttaaaaaacatgctatttattaactatataggctaactttaaaggaatttagctgaaacagtcttgcaatcaaagaaaagctatttaatattttacttctgatttgactcaagtgtttaaagtgtttattgatggtgatgcaagaagttttcctatcttacgtttttatttaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaaggtaattaataagagcctatgatactatatataaccttagaaagagaaaactttgatctaggaatagtaagttttgcagattacttttatcgttcatgttacacaacttcgtattttgttaagataggattttcattcactggatacctaggtttggcaatgcagggaggtgctaacataataatgtggtttatttggctgcactatggaccagagtgtagcaaatgatttgtggaaaggtacatagcaaatcgtaaaagtattttttcaatttcaagttaaaattattgggtcaatcagaaaaaagtatattataaaaataacatttattgagtatttaaaatgtaccataccattaaacactttgcctcacattaatctttacaacgaccctaagagataggtgcctttattataattaccattttatagctgaagaaactgtaccaggaataacttgccccaggtaacactgccaaaagaagcagaactggcactcagacccacctgagttcgaagcctgtgacttactctgtatactttgcctttgtccctgttgacttcagtatcgagaaagagtccggtaattggtgaaatgggtagataatagtactttactgtctaacccaggggtgttcaatcttttggctttcctgggccacattggaagaagaattgtcttgggctatacataaaatacactagcactaacgatagctgatgagctttaaaaaaaaacttgcaaaaaaaaaatctcatagtgttgtaagaaagtttacaaatttttgttgggctgcattcaaagctgtcctgggctgcaggttagtcaagcttggactaacccaaaataattctaagactcggtttttaatatttaggggtttttgttttgttttgtctttttaaatctcatgtcatttaagtcattttcccattttattgtgagcttctgctagatccacatttgttattttttccactcttgagtttgaatctcacattctcagaatctagtacatgaatatacatcttggttcccttgctcattgtcactttaaaaagtagggatgaaaatctgtcctcctataaagtaaatataggtagataacagttttaagttctagttaatagtcattgtttctcagccatccaatatgatggaagactgtgtactaagtggtgtaggctatgagaaatttaagacaagtttactatccttaaggagcatgttactaggaaagcattaacacaaatgtaaatattaaaaatatacaggacaaaaacctgttttaagaaataagtgggataaacttatactggtactgaatcagattttgaactttctaaaaatgaataacaattataagtagcttctataaacatgcagtaagttgatgtcaaattcaaatacattttaacgattaatctagtattaagtaaatttgactgctatttgtttttgatataagtattatggaggttttatgcagacttttttttttttgagacggaatctggctccgtcgcccagctggagtacagtggcacaatctcggctcactgcaacctccgcctcccaggttccagcaattctcctgcctcagcctcccaagtagttgggattacaggcatgcgccaccacacctggctaatttttatattattagtagagaccatgttggccaggctcatcttgaactcctgacctcaggtgatccacccacctcagcctctcaaagtcctgggattacaggtgtgaaccaccacgcccggcctgaagacttttaaaatgacccaaaaagtaactgcatatagagagaaagagagacagttctgtggttaggataataaactcagcgtgagactgaattggtggtgctttaaaccagattgttacccgctgcaaagcacagtaagatgaggtatagcatagtgcagtaggcttaacaatttactaagccatgaatgcatttggacttatttacaaagtaagaaaataatattcggatattctgtgaagtttagatatcttgctaacataatttttttcttttctttttctatgcctcgccaggatagattgccttttttcatgataagaatgttgtaatttgctttgagaagttctcatattggttcttttgttaatttatatctctgtaagagttattctctgttcttatccatgcttttgtgtgcctggtaatgtttatgtttctttgccaaaaaaacaacttatttagaaaaagagattgggagcttaccagaataccctgactaaacaaacacaccaaccaacaataaagcacaccagatcaaactgcaaatcaaaaaaaaggttttttttgcagccagaaaatagaaattaagatttaataaaaatgagttactgaatgaagagagagcaaagaaaaactttataaattttccaaactctttcacttccccaaagctaggtcgaaatctttggtatttagtatgctctgttttgaaaaatagcaccacatttttttttctaaaataagagaaaaggaaagtgctctgtttgaatacgtaattaaatcatattgtgtgggtgtaaaaaatgtttctaaatatggagaaaggtccgtaaaaatagagaaatagtatggacctttggttaaattttcagcctttttcaataagaatgaagtaaaattttagttggttttcagccatgattctcatgttgtaaaattgtacacaatttgtttaaaattgttactaatgatttcagtgtgaaaatgccaaacatttcagaaattaaatttgtaggaatgtcataaaattaattatttttttctagttattagccaccatgattggtggatattttggctcctaacagaaaaccagactttttttctcatcatagtgtacattggtaccatgtaaaattagatgctttcacataaaaaccaactaataagcaattgtgtaggaaagataactatatagaagcatggagctgcatagtaagggacaagcactgattgcctgaatgaattcctcatctatatcagtgaaattcttctttgaaaattaaagcttaagatgtagatactatataagggctgggagcattagctcaagcctgtaatcccaatacgttgggaggccgaggtgggaggatcgcttgaggcagaaagttttagcccagtttgggcaacatagcaagaccttgtctgtataaagaataaattagccaggcgcagtggcacgctcttacggtcttagctacttgggaggctgaagtgagaggattgcttttgccctgaagttcaaggctgcagtgagttatgattgtaccagtgctcttcagcctagcaacagagcaagaccctgtctcaaataaatatacgtatatataagatagatattgtgtaaatgctaaatctatctcagtacataatagtacatgtatttataaaatacatataagttaatatctaagaagttcaatgaaaatatttccaagttctagtgtaatgtcttccagttatccttatgaatagtatcatagcaaacttttgttaaaaattaatattaaaattacttttcaatagtcttggagcaaattattgggcatgcttttgaagtaacccttttttaaaaaatgcctttgtctcaacctaaatttaaaaatagcagtagtatgtaagatactgatggagtaggaggagtgatacaccctgctccatagcagtttggtcaaataaggagttgcagcaagtattcatattataatgtagcacagtgaacaatttgaacagccatcatttttcaggaagaagagtgggcaactgtacaagcttcttttgaatacttgtcagcatgctaattatatatttcttaagatgtgaacatttaggctctttgaattttactgtatttgaagaccttgtttcagatctggtgctatgtactgcatatttgccaatgagatagaaaaatgtgggtttgaaggtgaataagatggttaaattattaatggagtaattgggtgatttctcctcaaattttggtttaggatgttttaattaatgagtatcaaatcaagcttggtgattatttaaaggcctcaaatgtgtttactccaaatggaaagtttatgtctgttaatttccccctctttttttccagtattgcggaatgctgcagcactccttactctcttttgggtttggtcttcacggtttcttttgttgccttgggtgttctcacactctgcaagttttacttgcagggttatcgagctttcatgaatgatcctgccatgaatcggtaagttctttccttgattatatctagaaatgtaaatactatagataacttgaggaagtaatgatgaatttctttggctgatgaattttagaagaaatggaattggagaggttttttttgaatggttgcaacatttgggttaaaatactatgaaaaaatacatttccatgttaaagatgtatttgtattgtatgtattaatacattatgatgaatattgggcaccttccttccctagatttctttaagagattttcagaagcgtgctttttcccatttgaagtttagccctgttaaaatctgatttctatacagtatttgatgttaatatctggctcatttacagaatctggttggaaaacttctatttgtcttagaagttattatttttgccctcattgtgtggtaaagtaatagctattatgcctttgcacatgtagtgatatatatgactatttcattaatgttacaaagttaatatactgatcaggtttttagtctggattaagtcagaatagatttaaaaatatgtaacaagagtctaagcctttggattatttttctctttgaattaaatgagattcagattattttatgttttctgaaaatgtatgctttttttaggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagtaagaaacctcttaatattctttaaattaactcatgtaatattctttacatgcatttgttgtctaaatatttagggaatatttagagacagaaaatggatatgggtaattggtattagcttaggttaattcaacaagtttatgtttttatttttcctatatgagatgtctgacttacttgacttttgtttttttctctcaagattttttagttaaaaatgacatcaaaggccatgtaattataagttaactttttctgcttcagatgaagttaatactttttatatttgtccaattttaaaattaagaacatagagcataaaatttagtctagcataataaatgtaacaaataatatttaattttattctgtgtaaattaattaaaggagagaaagcattaagtgaaatgcaaatgaaggagaggaaaatagaggctatcaggtaatcataaaatagacatttatggaaaaacagcctcatttgatggagttttagacaatttcaactgactggattataaggattcttgacaacttataggaccaaatgaaattaatagttggattcatgtacatcttgcattacagtaaaattttaaactctctatattttattgatacatagtagtagtatatatttttgaggttcgtgtgatattttgagagctgtatacattgtataatgattaaatcaggataattgaggtatccagaaatttttgtgagggataaaagccaaactattatttagttccttaaagatacagtctttttattgtagttgatacaaggaaattctgtaaggaatttcttaaaattcgatgtcactgttttttttctagttctctatctgcattctgattattgattatagaaatacatctgaatttattgcttcttcggtagccttttatagtaagggaacagctaatctcttgggaggtagaattgtatcagctgatttctaaaacattccaaattaacattttaattatagtacatcagattcatctttgtatccccataacacacattgccaaacattctatataattttctcaagtggtaggatggctgaaaaatcaatttaaataagctcaaactattagacatgtttcagatcttcttaatcatcatagttgatggtagttatttcacatttgtttgtgaggtttaaggtttcttgactgaagcatttaaaatgttgaactcaagggtgagcgcaattaaatagccacttagtagatctgaaaagtagatttctttgacctaagtacaattagtattttgtcatctctgtcaatgtcatctgttattaattacactaattaatttagtatatattgataaaactaatatttagaaaagagaaaaaatatgttgttccactagtataagaatcagtggatggcagttgtgggtcttcccaggatactgaactatcctcactactggctttctccaaaattagatgcagaggagatttagagaaaaaggagcaaactgagaagtgttgtatgtgggccggggtactttgaattggtgtctgtgttattccttgtggctgcggctgcattaacctgaggcgggagaggctgccctcttggctgtgggaggaaaaatagacatgaactattctattctgttcttccctcccaccattgcctacagtaataagagactaaccatcagctacatgccagtatgttttaaaacaaatgaaataaagttaagagaaaaattccacttaccacaactgactcaagaactaaaaagttgaatagttctataacagttaaagaaattaaagcagttggcaaacttcttgagccagatgatattacaggcaagttctaccaaattccaaagaacagttatccctattttatttatttatttatttatttatttttagagatggaatctcgctatgttgcccaggctggactcgaactcctgggctcaagcagtcctcctgcctcagccttctgtggagctgggacacatgtgcacaccaccacacttggcagattatttaaaacaaatactttcaaactataagaggaataccccccaagtccactctgtgaagccatcgtaatcccaatattgaaataaaccagacaatttttaaagtatttcactcatggcaggagatattgcgaggcatttgtaatgttggcttaaggtagaccagtggaatagagaccacagactgacccacatatgggtggaactctggtatatgacagaagtggcatgccagatgagtggagacaggtgctactctataatgaagctagaaaaacactggattcctatcttgcattataaacaaaataactccagtatgttagggacttaaatgtcaaaaacagaaggttaaaattccactgagattagtatatttttgagtaggaaaagatttcttaaactgacagaactgactgtggaagactgagattgactatgactatgaaagaaaagattaatacatttaatgattaatattagaattaatggcagtttttaagttagaaatggtcattacaaactggaagaaaatatttctagtatgcactcctgatcaagaatcgctcctacacatcagtaagagaaagggacaaaaaacttgatgaggcatttaggaaaagagaaaaatgcaaacatgaagagaagttcagcatcattcatgataagggaaatgtgaaggctacagtgagatactgttttacatgcaatcaaaaggaaggagatagaaaggggagggaaaaaatctgccaatacctatgatgggggaagttgcagctccacaggatatcccatggtactgatgagagtgtaaagtggtgtagtcactttggaagagagtttggcatgatctcctcataggtatatattcaaagactcttgcatgtgtacagtaggagacatgtagaagaatgttcgtagaacagttcacctcaccagaatcctgggaacaacccagatgccaatgcaacaagaaagtagatgataaaatgtggtaatagtcacagtgctatgttaaaaatagtgacccacaaatcagtatgaatgatcatagcagcacgaggtaaaaaagtaaatccaaaaagatgataatgtaggatattatttttatgttaaaaacaaaattttaaaatttgtaatacttagaaatacatatagataaaaccaaactataaaaagggaagcagggaagagaatgaagcacacaggattcaagatagtggtttcgtggggcagaggggcgagaacatggtatatataggcaggcctgcccctgtcgttagatgtggtttattgtccaggccttcacctgtatgtgggaagtgggttcataaatgcttgttacattattggcaatagttaattagattactgactaaataaaaggagggacatgcacagacaaatgatgacagtacatcgtcaatcaaggattgtgatgaattcaattcagtgtactgggaattaaaaaaggaaaggaaaagcgtcctaattctcaagttagaggacaattaagagatgatactaatagttcatgaaacaacttttctattaatgaaataattgttaaagggaaaatcttcataaatacgtctttggagttgcttgaactgtaggtaatttccacgtttagcttaggaggatgtgtgagttagttttagccatagaaataattggttattttatctgtaaattttattgcagtttttaacaaggaatattagaactatggtctacttattcaaattatgtagcaaattttcaaaaggcaaacattttaggaaatgggttgtcatttttatagtacttaacctattgcacgaggtttcaatgtaattttcccttatttttatattttatttgaaatttgcttttatttaattttaactatttagataaggacatatatgtgtgtctatgtatatgtttgtgtgtatatatccacctgtattaaaattaggcataaatgtaaaactcttgacataacattgttgtatatacatttctgtgtgtgtgcttaaatctatgcatgtgtgtttataaatacgtacatatttcatataaatcatagctggcttgatttttaaaaaatatatttaaggttttaaggcagattgccctattagatctataattcatcatctaacacagtacagctactgcctttctttaaaaagttaaaattgctgaatctcaaagcaaagctactgacaagtttacatttgttccttaatttctgattattattattattattattagtttttggcaagaaaaaatgtaaaacactttccaaagtatgcagctttaatttttaccataataattaactttcttctctgaattactgattataataggaccacactgtatagcatttgaccttgtgtgtggtaacttttacttcctgactatattataattaaaggtaggagagatgatttatgttatttgtgtctctttgagatgctttacttggatttgagaacatatcacagatgttgatgtttaattaaaacagcttaaatttttttgtagccatgagctttatttcaattgaaagccaaagttgtttagcttgaactagcctaaagggtttagagaaatggagagcatgatggaggaatttctagtgggacgtaagagtgcttgtgttttgctgagagggcagttagttaataagcagcttggtttatgaggaacagatttgacaagcttggatggaaaaattaggagtggaggacctcaaatgccaggctcaaaaatttagagacagtgttgaaaatattacgatagtagagctttaggaggattagtctggctggcagtgtcctggatagatcagggctggaggagggaggaaaaccaggtagtagatcttacaatacagttgctctcagtcatgtctcccacttaccctgaccacaacagatgtgaggatgagtatacctgctcattggagagtcattcctattagtcacactgcactctctgtagcagagattctcatcacaagtggaaacagtgggaagagggtgtcataagatttgaaaaagaccacaaattattctaatactccctccctgtcttaaccaggaaaaattattgaaattgttaaggtttaaggctacaaaagcctgaaataatttgaaattgctaggagtagcaattgaaagcaaactattgaggaacaaaagaaaatcagctgtactttgcaattgactgagtgtggtggctttgacatgccaagcctgtgtgacttggtctgaactctagtacagtgactggcatggagaagggtgttcagtgggaatttgtgaaatttgatcatggcaccagagatgttagctgctgatgtgagtggttgtgctactaggtggcaggcacttaaaaagaataattttgtctttctccaggagcttgtggaaacacttccgtgctgtaagcctttgtttatttttattggtattccctgcttatatggcttatatgatttgccagtttttccacatggatttttggcttcttatcattatttccagcagcattcttacctctcttcaggtaagcctatgattaattaactctatataataaccaattttgttatttttcctcccagaggaggaattaaattttttcaagatgaatgattataagtggactattcaggtgataacttctctctctctttactagaacacattacatttatttgagcacaggagttagatggcaggttatgaaaatattacataaaccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtaaacccgggaagcggagcttgcagtgagccgagattgcgccactgcagtccgcagtccggcctgggcgacagagcgagactccgtctcaaaaaaaaaaaaaaaaaaaagaaaatattacataaacctattgatgtcactgtattttttatgaaggtaattaagcctttcagtttctctttttcaaaatggtatgatacagaggtgtcatataaatcttaaattgacaagtaactaaaatattaaaagtttttagagcttgtgttagagcttatttggagtgtgttttttaaattccactcaaaaataccaatagttccacgatgtatataaatatatatgtatatgatgtgtgtgtattgcacacatacagacatgatacatgtttcacagacatgcacacacaaaatattgccctagaaatgataagcttattgtaacttaaaggaagatctttgctacctaggtaaaggaaaacataacacagtgaagagttattcattatttttttgcagaagtaaaacttctttgcgagttgtagaacaggaatgactatggtatgaggaaaattaagatggagttgatgaggtttggtgacctaaggaataagggaaaaagatgaatcaaaaaattgattactcatcagaatcattttaggaaagtcacgtctgacggtgtggctttttgttttctatgcctggattactaagatcacccacattttagtcatcagtgtcttctctttagagttgattttttatttattaaaacttttttttcccctggatactcttctgtatatttgaaatattgcaccctaaaaacatcaggaatgtgttattgtttaaagcctatgaaaaaagtatcttagtgatcatatttcaagatacgtacattttttttttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggtaactccttcaataagaatgtgtttgggtaagtcatacagtgtatcccttgggactgtaaccatattaaccaaattcaacttaaatttctaggcaaaattatcttctggattaaaaaaaatggacctcagaaattatattaaagacctgataaaatatttccattttatttctaaattaagttttaaatttagtcccttgggttctaatgtattgttgttttcaacattattgctcacccataaataaaggaaaaacaggtcaggtgcattttatatttactcctgaatacacactcacacggactattgaatatactatccatgaggggtcagcaactcctgaaaagtggtgtgccaaaattctgactcttttccctctagtatttccagagtggggaagaaatattcatgtacctaacataggtagagagaatatgtgcccacctgtgggttgctaagtatccgagggtacaagcatttggtgggagtgggtgaatatggtaaaggctaccaaactgatgtaaaattgaagttggcctacctatagtctttagcacatgcaccataaagagcctgatgattgtcttctattacaaattaaaggtagtacttaaatcactttggaaataaaacaacaacaaaaagacctagagtttaatcatcaatcacctgtgcaagaggccgcactgttggaaataatggacagagatgatggccaacagcagaaactatgtcccatttttaaagtcactcaaagagtgtaggctggtagaataaaactatagatagtgtcaacaatatacaggggatattcttacttcaggattgcttttgtagtttaggtggggtatgtatgtatttgtgtatatttaaatttgtgcatatttaatttttttctgatagtaaaatacagctatcaattttttattttgattagaacatactttttgatcctagctaaacaatgttctccaggcggttttgcatttgaggggtctgaggagtaatgtagggttcctgcctcccttcaaagtagccattctcttagttgtgtttattattaaaatgaaccctagctcttttgtgctaggtagcctcattgtactcaggacaaagcacatcaaaaacagagtcggagcacctcagcttcagccgctgatgtctgaatattccatctcggggattcaagagtcctgtttgtatttcctgttgtcacatcactttttttgaggtgctagaactacctgttgatatcacatcgaaaatgagagtaaaactgcttagcttcccagctggctgcttttccttggatggctttctgcttaaaagttgactcccagatgttaccagttcttggcaaggaatttctgggatatccacacctgcttgttttgggacttgaaacaaaattaatggttgattcacgaaacgttatgtctttataactttaacttcatgtcttcaggcttctctcttcatatatatcttatgcaaggaatattaatgcaaagtacaccactccttattccagtggttatcaaatgtgagtgtataaaagtcacacaggtggcttgtaactatagattttatgaatcccatcgttacatatcccacttcagtaggtcttgggtggcccaagactatgtgttaacaagtggttcttatgcaagttgagaaacactggcttatatagaccaaatcttgaaaactgggtatatacattgtccgtaatgagagagtgccacttccttgccaataccctggtattatatggccgattttgtctctttgccaataatttcattataaactgttcagctgtgttgaagcaaaactgtagaaaaagtcctgtcttcatcagattttctgaggttgtaattatactcttgtcataccagtggagacccagtaatcatactgcaacaattgtgtaacacttgcatttcatactcaggcaaaacccagttataaaggtagcttcttcctcatttttggtttttccttcacttttagaaagtacttagccagtagttcttgcattatttgtataagggggatctgtgatggcagcaggattattactgatatataaagtaagttttattctaagatctatgttacaaattttctattgtgggaaagagatgttagaaccagaactttggggatagcaccaaagatactagaaaacagacatttataaggtatcttttttccccctcttttaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcaatattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataattatgttttgttcttgtggtttgttgtcattataaagtgctttttttgaagttctgttcttaggaggttctgtttttaatttagttggacttacatgttgatccttgtcagaaatgccctgtagatggcaaaactctttgattgaaaaggaccatttcttttgaaatcttctacacccagtgttagcaaacttacctgtgcttcagaagtgtttgggaagctttttattttaaaaaagtacacatttctgaaccttacttctgattcagattgaatcagccttttggggtgcctgagcatttcagagcttctatccagctagcctagcactaaggcagtatgacttgttggcggggggaaagtatctaggctagaattcatttctccccaggtgtagctggaagtttatcatctttttggtgctccgtgttaggcagaagacaaagcagatagctccctctagtggtaggaaggctgcttatccaaagacctagcagtaatgatctgggattttaataaaagtagagttctttggaattactttccacattataatacactttttacttcttaatagcaaatagatcccagctgtacatgccaaatcagatgagtgtgttagtagccttttggacaaatgtcactgtgtgtcaggaggaatatattatgtggttgtaacagaaaacctcaaaattatagtggctttaaaaccacaaagatttatgtcatgcacgtacattacaaggatatcctgtttggtgcagacactatcctgtttggtgcagacactattgaactttctggatggtcatgccaaagggaagactgcaaggctgtacaccagcaattacacgttcctccctggtatggacatgtcacttccactcactcccttggccggaactactgatatggccccaccagccacaacagcacagaagttgtcttccacgtcctagaaagagagcatatcagtgaccagcactctggtggagcaacttcattttacagattatttgaaatttgggagcacacctgtgaatggttccaaatatacctctgacttaatttgttatttgtccttacatactggacagtagcattgtataatgccatccgtattcaaaatctagccattttgtaatagcttccaactcactgcagagtttttgacttaggaagaagacaaagtttaaccacctggtttgttctactgaagagaagatgagaaaattagattcagttcctcttctattatgcttgatcaaattgagagaatcatcagttcccttatgagtcctttttaggtcacttttcttgtctacttaatggtttccagtgttttcagacagtgcatacctattttcacgcatcaatattcccttaaaaactttgtaataaggtctgtcaccttatgcactttgccatcaaaattagtactgtgacaatcctttatcagtcctcttggatttagggaaatggacagcacagagggataaaaggggcttgcactaagggcaggagctctggattataattctaagtcctctgtgatctttgattagcctttgtttttctgggcatcagcctcatctgaaaaaaaatcatcactgaagtgtcattctgtttcaggttttgcccatctgtatttttaatcctcaccactgactgagtaatgagcttcatatttttgaacagttttaaactagagacagatgcttcatttttttttttaatatgctgtgctacatattaaacttacctaagattcggttcaccactgtgttcccagtgtctggtatagggcaggagcactctaaatatctacagaatgaacaaaggaacttagcaggtggctcctcatatccaccctgtagtttaaaaatggcagagaattctattctttccagaggcagagagcataatattgcatggcaactaaatgaagtaatttctgtgagtgggttttgatcgtcttaactgatcagatcctgaactcagtttctagagcagaaattacaaatttggggccttctgggggaaatctgggctgataaattttgctttgttgttaggcctcagtgatagatttattttattttatttatttttttgagatggagtcttgctctgtcacccaggctggagtgcaatgtcacaatctcagctcactgcaacctccgtttcccgggttcaagtgattctcctgcctcagtctcccgagtagctgggattacagacatgtgccaccacacctagctaatttttgtattttaatagagacagagtttcaccaggttggccagactggtctcgaactcctggcctcaagtgatccacccgcctcggcttcccaaagtgttggaattacaggcatgagccaccatgcccagcctcaatggtacatttttaaatgatattttaaaaaatatttgaatcagttgccaaccatttaaaaattgcaagattgtatatgacaaactcaatttctatcttcttgtgaaaaattggaagtgctggctgcataggccactcatccttgcttggcaacagtccgcataagctgggatgggctgagtttctaattcacccctgtcgtctccaccacagcttgctctagcaaattagattgctgtcatcagactcttccgtttgcttagaggatgccgtaagtgaacactgggcaaattcgacatctcatttaatcacagtcaaatcctatatgaatatgtatagtgcagatattcggtattgattaaagtgaaaagattaaaaaccagaagcaatgtgtataaatttgacattcatttatggaagtatagaacctgtttgtttttctttaatgaccggagtgcagtaaaagaaaaaaaaaatcaatgagcaagtgttttatttgaagatattttcaatttggatctatgctagaattttgcattttggtatcaccaagttgttccatgagcagtgtttctcaacctttgatgggcgttggaagcaggttgggaagcttgtgaaaaatacaatgccggccgggcacagtgcctcacgcctgtaatcctagcacttagggaggctgaggcgggtggatcacctgaggtcaggagttcaagaccagcctgaccaacatggtgaaaccccgtctctagtaaaaatacaaaaattaggtgtggtggcacatgcttataatcccagctgcttgggaggctgaggcaggagaatcacttgaacctgggaggtggaggttgcagtgagccaagatcgtgccactgcactccagcctgggcaacagagttgagactccatctcaaaaaaaaaaaaaagaaaaatacgatgcctagacccagtgccatagattctgactgggtaggtttgggatggagcctggtatcttaccttttccaatttttcagatgattctgattctatggaaatgtgagtacctttcatttaaatattcctgctatttcagtgagagggggctgcttgttcttggatctaccatttttatggaagaagattcttagagaagaaatacacatgaggtttgcctctgggaaacattggtggttaaggatttcagcaaacattacaaccgatggggtttctgcagtgaagcagcaaagcctggccgacacattatgcaggtgtgcatgtgccatctggcctaatctaccaaccttttttggttggttgaccacccaaaagtgtctcaagctatttatatttgaaggtaaaatgctgttagcaccccctccacctcctctttcccaagcatatggaattaaagaatcacagaattttggaagcaaaccagccttcagagatctagatcagtggtcctactttacaagagagccaattatcgatgtgtccaaggccacacaattgatggcaaagcggggaagggtgctcaggtctcctgaatccagtccaatgctctttccgttacaccttctcacctcaaaaagatccaaacacccatgtgtattttgctgcattcaataaaacttatattaactttaaagatgttacacgagagatgtgaaaatctgaaacaatttctgagatattataatatttaaaattatcaatttgagatcaaacgtctggcaaattatgtaaaaagggaaaacaaacagtaaaaaaatatgggatgtagaataaatcttagtatacggcaagccacaacccatcaagatttggagttggaaactgttggctacaaaataccaacatttaatattaaatacgtaccatttaatataaaaatgccttctgcatattagttaaagccacagatctgtgcagactgtgtaatcacactatttgcaggaacagatgggctgtgtttaaaataggagtcaagccttagtttagagaattttaaaatataaaactgcttccttcccaagataagtattaaatcgtcctaagaaacacatgtgagggatagatagacataaacattgtaaattcccattttttttctctagttgattagaaaatcttttctgaagtcatcttcccaaaattaccttgaaactcatcccctacccctaaaaagaaagcccaagttttaagggggccattatgtttatttttgtaattatgagctacattgtgcaactcaaacgaataaacttgcaagatggtgacctctgtatgtgttttggtgctggtgctgttgctggtgggggaccgatatcggaaaggccatgtatgttagaaaagtatgttcacaggagaaggaagccaattcgctgagctaacttgtatcataacattttagactttcaacctgtatctcacaggcttacagcctgcctccatgccattgccatttatcttttgttatgggtttaggttttttagtttcttctacatttaagaagaaaaaaagcacatatagcttgaacaaatgatacctgataaatgaatatgctcagctgggtgaggtggttcacacctgtaatcccagcactttgggaggctgaggagggaagatgttttgagcccgggagattgagatcagcctgggcaacatagggagaacctgtctctacaaaaaattaaaaattagccaggcatggtggcatgtgcctgtaatcctagctgctcgggaggctgaggtgggaggattgccaaactggggaggtcaaggctgcagtggctgtgatcatgccactgcactccagccagggtgacagagcgagaccctgtctcaaaataatagtaataataataataataataataataataataataacgaaaaaaaggaaaagaaatgcttgccaccaaagtgtacttgttatttcaagggaaaggaaaaaacaactttctttttaaaaagatgagacgcaatattaactacttagaaaaagaacttgaatatttaatttaattaattaatttatttttaagaccgagtcttgctctgttgcccatgctgtagtgcattggtatgatcttggctcactgtaacctccgcctcgtgggtttaagcgagtctcctgcctcagcctccctagtagctgggactgatctgcccacctcagcctcccaaagtgttgggattacaggcgtaatcccacctcacttacaggcgagccaccgtgcccagccagaacttgaatatttttaatgtaatatggggccgaaatatacttcttaaatcacacatgcaaataaaaacaaacattttgcttagtcaaatgtatgtgtatatatagattacattccacttaggagatgtgtggatgcaacaaaaaaagaaaactgcagcccaatatcactgataaacatagatgcaaaaatcctcaacaaaatactagctaacccaatccaacagcctatcaaaaagataatacattatgatcaagtaggtttcacaccagggatgcagggatggtttaacatatacaggtcaataaatgtgatatatcacataagcagaattaaaaacaaaaaatcatatgatcatctcaatagatgcagaaagaacattttataaaatccagcatccctttatgataaaagccctcaacaaagttggcacagaaaggacatacctcaaagtaataaaagccatctacgtcaaacccaaagccaacatcatactgaattgggaaaagttgaaagcattttccctgagaactggaacaagacaaggctgcccatttttaccatttctattcaatgtagtactggtagttccagccaaggcaatcaggcaagagaaagaaataaagggcatcgaaattggaaaagaggaattcaaactgtcactgttcaacaatgatatgatcatatacctagaaaaccctaaagactcatctgaaaagctcctagatatgataaatgaatgcagtaaaggtctcaggatacaaaatcaatgtacaaaaatcaggggcatcactatacatcaacaacaaccaagctgagaatcaaatcaagaattcaatcccttttacaacagctacaaaaaaaaatacttaggaatatacataaccaaggaggtgaaagatctctacaaagaaaactacaaaacactactgagagaaatcagagagaacacaaacaaatggaaacacatcccatgctcatggatgggtagaatcaatgtgaaaatgaccatactatccaaagaaatctacagattcaatgcaattcccatctaaatgccatcatcattcttcacagaactagaaaaaacaatcctaaaattcatgtggaaccaaaaaagagcccacatagtcaaagcagtactaagcaaaaagaacaaatctggaggcatcacattacctaacttcaaattatactacactgctatagttacccaaacagcatggtactggtataaaaataggcatgtagaccaatggaacagaatagaaaatccagaaataaagccgaatacagccaactgatcttcaacaaaacgtacaaaaatatcaactggggaaaggacaccctattcaataaatgatgctgggaaaactggcaaaccacatgtagaagagtgaaactggattcttatctctcacttcatacaaaaatcaactcaagatggattaaagacttaaatctaagacctgaaaccatgaaaattctagaagataatattggaagaactcttctagacactggcctagacaaagagttcatgaccaagaacccaaaagcaaatgcaacaaaaacaaagataaataaatgagacctaattaagctaaaaagcttctgcacagcaaaagaaataattagcagagtaaacagacaacccatagaatgggagaaaatattagggaatgtaaactaatacaatcactatggaaaacagtatggagactccttaaataactaaaggtagaactatcattagatccagcaatcccactactgggtatctacccaaaggaaaagaagtcattatatgaaaatgacacatgtaaactcatgtttatagcagcacaattcacaattgcaaaaatatggaaccaaaccaaaagcccattagccaacgaatggacaaagaaagtgtggcatatatcaaggaatactactcagccataaaacggaacaaaataatggcctttgcagcaacttggatggagctggaggccattattctaagtaaagtaactcaggaatggaaaaccaaatatcgtttgttctcccttataagtgagggctaatctatgagcatgcaaaggcataagaacaatacgatgcatgttggggacttgggggaaagggtggaagggggtgagaaataaaagactacatattgagtacagtgtacggtgctcaggtgatgggtgcactgaaatatcagaactcaccactaaagaacttatccatgtaactaaaaaccacctgtatcccaaaaaccattgaaataaaataaaaattataaaaagatggttggatggaattcaataaactcagatgcaatgtgatacattcagaatctagtaggaaagtaccatttggccaggcgcggtggctcatgcctgtaaccccagcactttgggaggcgggcagatctcttgagaaatttgagactagcctgggcaacatgacgaaatcctgtctctacataaaatatgaaaaattagctggatgtggaggcacagttgtactcccagctgtggtcccagctacttgggaagctgaagccggaggatcgcctgagcctgggaggtcggagctgcagtgagccatgattgtgttactgcactccagactgggtgatgaagtaagaccctgtcttggaaaaaaaaaaaaaaggacaattagtaacacatcattgtatgacatgaactttgagggtcccccgccaactgccccccaccagcatggggatgaggagatcagtgtgtgcctagtcattctcactgaattaaccaattcttgcagtgactactaccatgtacttaaagagagaaatagtctgaaaactagagaactatttgcctttcctctcctccttgggctttgacccccccaggccttatttaccctctgttctggtcaactgagctaatggtccatgttatccaaacatctgacacatacatcaaaagaaacactatgtcctttttactttcttttttaaaaccatactatttatatttatttatttagttatttgttctagttttattgaggtataattgatgaatgacaattgtatatatttaaggtgtacatgatgtttgatatgtgtatatattgtaaaatatcaccacaatcaagctaatttacatatccatcacctcacagtttccctttttttcccatatgtagtgagaacacttaaggttcactctaagcaaatatcaagtatactatacggtatcattaactacagtcaccatgctgcacattgggtctccagaacgtattcatctcataactgaaagtctgtacctttgaccaacatctccccattttccctagccccaatcccttctgtttctatgagtttgacttttttgcattttatgtataagtgagatcatgtggtatttgtctttatgcatcttatttcacttagcataatgtccttcaggttcctccatgttgttgcaaatggcaggatttccttcctttttatgctgaataatattccatcatgtgtatatgtgtatgcacacataccacatttttaaaatcaaatcatctatcaacagacaggttatttccatatcttagctattgtgaataatgctgcaataaacacagatatgcagatacctctttgggctactgatctcatttcctttggatatatacccagataggattgctggatgatgtggtagttctatttttaattttttgaggaatctccatactgtttttcatatggctgtgcaagtttacattcccatcaacggattacaagggctcccttttctccatattcttggtaactcttgttatcttctgactttttttttttttttttgagacggagtctcactcttgttgcctaggctggagtacagtggcgcgatctcggctcactgcaacctctgcctcccaggttcaagcaattctctcccccacgcttccccagtagctgggattacaggcactagccaccacaccaggctaacatttgtatttttagtagagacggggtttcaccgtgttggccacgctggtctcaaactcctgacttcaggtgatctgtctgcctcggcctcccaaagtgctgggattacagacatgagccaccgtgcccagcctctgactttttgataatagagattctattataacaggtgtgagatgatatctcattgtggttttgattttcatttatctgataattagcaaactatatcctttttactgatagtctccaagaaaagaatagctcacactctgtggccttctaatccctttatgaataactcatgaactccttagaaccccctgtaggcattatcatctacatatccagatgaggaagctgaggcagagtttga

SEQ ID NO: 16 - DNA, 419126 bp, Homo sapiens
  misc_feature (1)...(419126): n = A,T,C or G
tccacacgtctgtgccaggggtgggatgctgatggaaactccatctggtgggggcagcaacagctgtgccaccgggaaggggatttggtaaattgcactatggctcttcatgcttctgcccctgtaagtgacacatgtcacttctgctaattcattatttgccagggcaaatcacaagatcacagctaaatgcagaagggtcagaatacttccatccttctatgcacctggaagaagaaaacccaaaattttggtgaacatctctaatggccaccataataggaataaaaaaggaaaacagaacacaccccaactttgtcaaaacgccagtgtctcacaccatcaatatgaatcaaattcccaaatatccatcagctgtacaataaaatatcttaacacattatagagtttcctgaatccatttcttcatctctatacaagagaattgcatagaatgggaagcaagtacaataaagtaaattaaactggggctggagtgaagtttctagaaatggactgtgggccagcaaaatgtggaggcacgtttataccttttgtggattttattagcctcatttctcagaggagaaatcatgtgtttatgacatgacaatactagtcaacagtctttccaaaataattggacagtaggaaagttatagccgtaacaggggaaaaagttcattttcacctaattgacaataggaatgtttgtttaatgggtcactctagaaagagatgttaaatctttaaaacttaacctttttgggaaatgtcttaaggtctagaatatgttcagacaaccttcatttgtttattttatttggatacaatcatttgcttagacatgtatttttaaacttttaatatattagtagtaatacattattttatttgagttttcttttatttggatacaatcatttgcttagacacatatttttaaacttttaatgtattggtagcaacgatgttttcaagtagggaaacacttaaactagctcagaatctcccctaaattaaaaaatagagttttgtactttccagaataataagcatctttttctttttcttttttctttttttttgaggcagagttttgttcttgttgcccaggtggagtgcaatggtgcgatcttggctcactgcaacctctgcctcctgggttcaagcgattctcctgcctcagcctcccaagtagctaggattgcaggcacccgtcaccaagcccagctaattttttgtatttttagtagagacagggtttcaccatattggccaggctggtctcgaactcctgacctcaggttatccacctgcctcggactcccaaagtgctgggattacaggagtgagacaccgtgcctggccaataagtacttttatagcctttctttaaatctttcttggtaaagatctacaaagcaggaggaaattacaagaggcaaagtttgctggtttactgtttgattatatctctcccactaccccttaaatatttgtaacagagcagggttaacattaacaccctaaccaccataaactaaaaatatttattatataattcatgtctaagatgaaaatgaagatataacagtaagatgatttcatacagaggtacagggaattctgtgtgactagggtaagtcaattttgtgtttttttttgtgtgtgtgtgtttcagtagtttcgagttattataattactgagcaatgactaaaatgctatatatcatgtaattcacatttttttttctcatttaatcctccacagaaaacctacttttagaacttaggaaactgaggatgaagtgacttgaccaaggtctcctagctacttagcagaggaatactctttagagataaataattgtggtgacatttcaatcaaagtatctgataattgcagtgccttcccacacccaactctctaggagaagaaataatttaaaagatacatttattcataaacacacaagtactcattctgtgtcttttcctatcacaaagcccacggatatacagctgaataagtctgcaagtcagaggttaagaaaagttggctctggcatccgacaggctgacttggatgaggctctgcaatgctaccttggatgggtacttattttctctaacctcagtttcttcatctgcaaaatgggaaacaatattcgtgctttcctcatgattttgctgggaaaatgaaataagacaatatgtttttgcacagtacagtgcattaaacgctccatagtatgcacttgatatatactaggttttattgttgaataagcaaggacagccatggctcctctcagaggagctccctgattagggagaggagaaaaacgtttaaatagcatttcctgtccaatgtgatgcgagcagtagggaaaccagggaaaggcacgaatgactgccttggaaaagtctaaaaaggtttcatagaggtgacttttgagctggtgattttagggggagcagtgcttcaccggatggagaaggaggtagacattccggctatgtccaaacgtggggtagaaaggcgtgtttggggacctcaatactcaggataagggaacattgaagagagagaaagggaaataatgaaagtgcatggaaaaccagtaagtgtgggaccctgggggcttggaccagaaagggccagccttccgtggccatgagggagggaagctggaggatcgcgaggtggcgctgtggctccaccttaaggaaagattctggagctcgcgggtcacccgcactcccaggacagcctcggagaggtggggcagcgcagtcttggtgggtttggcatcttcacggcagctgccaaaaaataacgttgataaagataataaatacataagcaaataaaccggaagcggtcccttttaggacacacggcaagcatcaataatcagagaccgtaggcgaggaaggattaagagcacggaactgtccagcagggaccgttcccagctcagtccgcgtaatctgtaggcccgcattgggaacccgcatcgcctgcctggagctgagctgtatgctaacccgcgtcttcgggcgggccctgcgccccgaaggcgtctccctaaagccaaagtcgtagcggtctgcacgcctgcccttgggccctcggtccgcaccctgcctagacctagatttttttggatttttttttttttttttttttttttttgctgaatttcatacgcacacgtgcacacaaaaccacgtgtgagttcaggctcacacacgtttacgatgctcttgcacaatacacacggacttttgcaaatgcacaccccactcacttagacactacacatgacacgtgcacacactatacacatgcgcactcacgcccgtgtgcaccaatgccttacgcacccacgcacacattcagccaagtgctctctgtcaccggcacaaacacacacttactgcaccggcccacaaatgtgcagccacttttcgcacatgcaaacatatttgcacattcacatcatacacatctcgcatcccagtagccaacaaagacctcgcagcacgcaaaggtgtgtaaatattcagcaaattgtccctcgaaggaagtatgagcgcaaactttttgttatccaggcatctcgagcttttctgctaaactcgccctcccttctccaactttcccctgaataaacaggcctgttcctcccagtctcccctctgagaatgttttaaggccaaggtttcttccataaggtttgcgctactgaagggatgctaattttcaaatcgctaagaagctcccttctcccatcccagagcctccttctaccaagggagcagggaccttcccagatcggattccaatctcgtggactaggggactgtgggcaagggccaccgggtgggatatgatcacgccctagggcatcctcggacttaaagatcctttccggcagtgcccccaactgtattctcccgactcagaatgacttcagcttctagctatctatggtcacgccagggcagaatcagcatctcccccattaaagcacatccgcaagtgtccagatttctgtccttcgatgggcatcaggaacatccccgcaaagtcagatacttagtctgttccaacaggcaagcttgcgtgagctctaagatctcatctaggactgggagagagaatgactgacaggaggtcacatagtaaatgtggcagagccggggccggggctggcacgtccctggcgcgctctgtccctgcgggccaggagagagagaagcacatcggtaactgaccacgtgaatgcgcattcagtacgcgcattagttaggacgtttcatagtcttcccctttcctctcctctgctccctgccctcgggaggcaccgtgcgcgctcgctcctttctcctcccggatgcggaacccgggcccaggagctccagagccaaaggacacttgagagttgggggacaagagattcgcgccacagctgggtggacggtttggctctatatttaaggggacaggctttagcgatattctggcttggcgactttattagctgttggccgtggacaagtttttcaacttcgctcacagggtctctgtttgctcacctgtaaaacgccggagtggtcttatctgccgtggtctgtggcggatattcagtgagttcctgcccgtaaagccttcaacaaatgggatctattattatctggggccgcccggggggaaacccaagagagttggcaggctcgccccagaaagacctgtaggaaccccttgccccaggcttctggccgtatcagactaagcgctcccaacctgggacggagccccgcggtgttgtttgcttggtctctatctcctagccgtctgtgggtgtctttgtccttctctaggcctcagtttccctgtatgtaccatggggggtgggaggtggaagtgcgctcccagagccgggaagtgtcggtcatactgggccagcagaggaggccttctctggagcgcagggaatcggaaacagaaatcagattctggatttccagtggacccctggcctgctactcccacgcgttccccgaggactgcgcatggagatcaccgaggaaaagagccacggttttgagggctggcggtgtgtcacggtgttcggccactcgcgccatcttccgggtgcagttcaggggccccgcagagccgagccttcgcgcaggtcccggctttcccaggtccccgggccgccacccactcctattctcgtccaccgggcaacgccgtggcccctgctcctctccacctcaaccccgactccaggctgctggtcgactcctctggagcggccgcaatctgagggactttgcgccttggcttaggtccttgcatctttcttttcccctttcccttcccaacactgaagtaggcatctgtcctcccgcctcgttcgaagctgtccctggcaggtggcgagggaagggggcacgtcccgggacggtttgcccttctgtgggcccgccctcacaaggggaatggagatcaagagaattttccaagtgacaggtcccaagtctggcctcctgggggcggacgaacagagacgattccctcttccgctgggacctttccacgggtcttagtttggctgtatttatctagtctcttctctttggggagaccggtatgtttctactggagtccccagaaattactggtagatgttgcctttcagaaaggggaattgatttccctgtgcctcaagagggttgggatagccaaggagcagaaggtcagggtgggagtgggtgggtagggagtgcttgcacactgccctgggcttcctccaggcccaggtcaagagatcccgagagctggacagccctgcctaccgctgggagcatctgaggggctgtgtatcctgaactcccacagctgcagaaattttgaggagctcatcagggaaactaggctccaggggaaaccccaaacctctctagtttttctttccaggtgtaaactcattctgctgtattttttccccatgcaaaagtcttttttcctcacgccttccttcccttccttctttctctcagagatgatatatattcaaaaatcaagagtttccaaataactttaaatacagatcccaggcaccaacacaggaggttctgattctgtgggtcaggataaggcctggaaatctgcatttctaacaagtgcctgcacccttccccatgtgattagcctgatgaacccagtttggggattactattataaactaccctaaagtcaaatcactcatatgccataaagcctaggcaatgctgtacatactagaatatctcattacaggatacctttaccataaagtatatacctaaggtaattgtgatggatagtgcttgaagtatctgctttcaggtatgatggcaatcaccctctacacacatgctttgtctctggaggtagtgctaccctcacatgaagatttagaagtatttaagaggctctttttcaaagtttaaaattacaattgctggttcaatattcaccagagaaaatccataaaaaaactactgctctgctggcctgtgtgtcatttccagttttctgtcactcactctgtctctcttccaccttctctttagcctccttcctacttaaacatttattacaggatgagaaagccagactgaaagcacaaggacaccaagaagaaaagctatgaatacactcggcttgattaaaataaagcacactcaccaccccaggtgaggtatgtgctgcctctgcacagccaaaggaaattagtcttatcaaaatatttctgcccccttttatttttcttccttctctagcctggcaggtatggaaattgcctccctcatatttagttcctggagagactggctctggggtagaaattgagctgctcaggacttcttgctttgtgccactttctcatttgggtgagtcagcttcaggctctcaacaaacgcatcctttgcagatgcttctagattctgttcaaccccagaaatctatctgctgtgtgtctcttgctgatcctggacttgagggtgtctatgcttttcttttccctggcacttttgtcaccttcctttggcagtgatctgctcccttattttgtgtccctcaccactggagacaccccaccagactcagctgggagtcctgcagttgaggactgtttactggagagtaaaatgcaggttcaggcagataaagagaaggaggcctaggccttttgccagggctatatgggacccattgataggatgggtgggctttgcttcctcatctccttaccttcaaggatcctctctgagctggagaatatggcccaggcagggggagggattgactctggggacccctttggacctggagcataaggttaagtttggagctttagaaagtttttagcaggccaagtttcaattgtgcatttaaatactatagagactgaaaatgttcacatacctatccccaaaaacctacagcccttcaagtctctccaccattatactcttcttcgacatgaacgctatgttaggaacccctgtaaatgctatggggatcccaaaagatcagaccaatcccttcagggaagtcctggaagagatggcattaattatggtaccaggggaaagtgctcagcacacaagaagtctagattacatgtgtgagagctgggcaggcctcgtgcacaggagataaagcagtgtttgaggacagtggccatgcactgcaggccaggaccacactctttcatccagtttaggaatcaggaagtggctccactgctctgccaagagcacaaagcataactcttgcctgtctctattcaacatgggcatgtgtacttttccatcactgaccccatgagcttcctaaatcaaaggaccaaggaaggccagcagaaaggggacctggatttctggcagataatttccccgaaggagtccttagcagatttggctgcagtcagggagttcctttgagggcaatgaaacagaagttcaccatgtgcttattagaggttacaacctgctaaaaaatgatggggcacattacccagaaacttctagctatttcctttgccagccacaaagatacatgctgaaaagcctgaggagggagacaatttcgtccttttttctttccctttttccttccatctctcccatttccattcgttccttctccttctctcctttctctctccctccttccttcccattttctcttccccttcttccttttttgtcctttctccccaccttccttctcttctccccccacccttttcatatggcagagacagagttaggaaggatttgttcaagccctcctttttaacaggaagaataaaggaggatgagaaaaaccctacaccaaataaccagctaatcaaggacggttaacattgctgttgctttggtagttactctaaaaacaaacgaaccaactacttggggtggggaatgaggggttggcatttaatttgagaaaatttaaaaacgcatcctgacacagccccagtgagagcattcattccaccattcacatatctcgaggactgcccgagagaggtgagcgtgtgagtgagaacagtgcccaaccctggcagcctctaggctagcggccgagagagaagcgtttcagaggccggggtgggagtagagcctggtaccccacttcctggggacccacagcgcctcatttgccggggcccagcgtccattcatccctcccagcgtggaggccgtgcccctccgagagttaccagccccgacctcgcgcacccatattccatcccaccgcccccgcctcaaagcgaagaggtgggcacctgggacgcgcgtcctgctttttctgcccgggctctcccgtctcctccacttttgtccccgacgtcccagaacggcggagcaggacgcggcatcagccctgggagggcgcagcctgcgagcctccagcgcgctcagggcgcggcgaggatgctaaaggactgcaatggccaggatgcagatccccagctcaaattcctgaggaagacacccgcctccctttccctctgtcccctctccgtcctcgctcggacccgctcctccccagcccagacgtcagtgctcagcgctccttcgctcgccactttgcgaggaactttggccggctcccctgcgccaccgggagcgggatgttaatgagagagcgtggcctggcgccgccagcgagccggctcccgggccgcgattggctgcggtgggcggaaagatgacgttatgcaaatgaaggggcgnnnnnnnnnnnnnnnnnnnncctttggggttagtgtgcctgtgtttagctctggggaaagtcaaactggattccatagggaaagcctgcaaatcacttctattttagcaaggagaaaacagaatctccatccagcagggtccacccctctctctttctccctctcctctctatctctctttccctccccccctttcctctctccctctctccccttccccccaccctctctggtgtatctgtctacggcaaccagcgtcctcctcatctacacgcaaaggaaagaaacatctttggttgggagagaaggaggaaaaaaaaagagagagagaggaaaaaacttgcctggttgtggaaaatgacacttgaagtagcaaagccggcagcgcgagttgagtctattgtttcttaaattgccatcagggttttttttttttttttttttttttttttttttttcttccggcttcttcaagtgaagggtacctttacaaaaggaaactccagcccctcctgtcctccaccggcctgtgatcattacaaaaaaaaaaaaaaaaaagcaaaaaaaaaaaaaaagcacccaaaccaaaaatcaaccaaccaaacaacccccaacagccaagcatacatctctaattttattattttggtcttttcgttggattttccctttcttctttttttcgggttatcgctcagttttgagcagaggtttacattttttaaaaatttgctttccagcccgccttgatcttctaagtgcgagttcatcgtctgagaaaaaaaaaaatctctggttggcgtttttgtttcttttcttttctttcttttctttccttttttttttttttaatttttttcaagggggaggagattttccacaagaaaaggttgttttcatgtttgggattcaggaaagcatccaacggagtggaagcagcatgaaggaagagccgctgggcagcggcatgaacgcggtgcggacgtggatgcagggcgccggggtgctggacgccaacacggcggcgcagaggtgggtactgcgcggggaccgcggccgaggtgagccgcgagcgggagagccgggaggcggaggcggcagcggcagctgctgccgcggggccgggcggcggggtgagtccgcagccgctgcgctccgctctccgccggggctccgcgctctccagccgctctgccttcgtcgcctgcggccggaggacctggagctgtctgcgaggagcccacgctttgccagcactttcccctgcctcgtctgtgactgttttcattttgttttaacccagaagaggcgtctcaacacagcatgttggagatctgtgttttatgtttttatgtgattgctctttcttttccggccggctctcttttcttctttcccttcgctcttcctttccctcttttcttttttctttctttctttctcttccttccttcctttttctttcttttttctttttctttctttttttctttcctccttttctttttcctttttctttctctttcctcttcctgcctttcttttttctttcttccttctttcctttctcccccctttattttcttctcttctccttcctcttcctttcttcccctcttccctccttccatttctttcgttcttccttctttcctgtctctcttcctgccttcttttctttcttctttctttcatttccttctctcatttctttcccccaccttcccttaatttctccctcactcttttccttcctcccttcctctctccattttctttctcttctttcttcagcttccctcctttctcctctttctcctttccttacctctctggctttcctgttttttcgtcccatttctcccctgagtcttctcttatttctgctatctcgttctccttccctccctctctgtctttcagttttttcttagtctaccggtagaatagcaactcccaactttaattctgatatctcccaaaagtcttctccagcccctgtcaccatggccccttccagcccttctctcactcgcagctccctagacactagactgtgtggcctggaggcattgcccttggaggttgacctgagggaactttcctgggcacacccaaggctctttcccaggctcctggtcccaagtgagaaatggcctttttccccccattaagccaccagctgagcttgggacagtgggagatctggtggccccaggccctatcggactcagagtgcggaaggggaagaaggaagatgactaattacatcatctccagcttccctgggctggggacaagtgtccccaacactgttcccatccccactgagtattaggatgggggtgggtggtagtgagagtgaattgggtaactgggctggaagtgaaagtgtgtgcgcggggcgctcgtgtgtgttcttctatgtgtgtgtgtgtgcctgtgcgcgcttgtgttgggcaggtccggctgtcagtggccgcctggcgccccaggcgctccagcctcccatcgccggccggcgcactgagccagcagccctggcctttaggatttctggaatgagtgtgaggatttctgcggaacagcgaaactttgttaggacaggtctttaagaaaacacccctcttccctttttcacagcgaccacccgcgacagttctgagccccgccctcggacccttctccacatgctttttggtggtggggggatgtggcttcccaaggccgggcactcgcagttggccagagcttgaggggttcctggagggtggctgctgcggcgagacgccgagcatgttttccatccattcccacctgccctgctagctgagacgtgagattcgaggggtgccggaatataactgtgggttctactccgcgaaggtgggttcacttcatccaccgccacttttcttcctccccacgcagtgcgtgtcaggtaggagtaaatgcttatagagtttcatctcgcgcgcaaaacccaaacaaaactttcacacctcttcagcgagttctgaggacgcacccgtccttggcggagaggacgaggacatgaggggacatgtgtgtcccgttgtcagctgggtctatgtcgcctgaaggggcgtgaagagcgcccactggatgttttgggggaagaggaggtgggtgtttgagggttcgagtgtgtgtacagggtgacaaggggcgcgggtcggcgtccggtttagccatctaactctgcgtctttggccgcagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagtaagtgggcgcagcgctgtcgcccctcgtccccggctcggctcgggagcaggcccgggagccttgggcagcgcgcccttccttgagtgcaaagcatccataacacacttctatgtgggggtcccccaagccacttcccatcccagacgaacccagggtcctggtccactggctccttctccagaaaagttcgcacggagcccccagagctagagagaggcaagcctggctctacaatccacagccatgggcacccggaatgaacccgccctccactaccagattacgcaccgcctgcctctggtggccggggcacgagcccctaggccctggaaagaggatagcctgtgtgcgcccgacggaattttcttttgggagagagggagcagtcaggaacggggggcggaggagggatcacaattggccacaatttctgctgctaccgtggctgcctggctcaccagcgggggtcccggcttggggaaagttgcctcgaaagttggtccactcgctcacgcagacctctctcctgcatctcttgtgtctttgcgtcctgatgcaacccaggaagccaacagcgaaaagaccaataacggaattcactaccggcttcagcttctctacagcaatggtgaggcccgggtcgggtctatggcctcaccctggggctccgggtctgggcagggggcgcagggagctccaggtggacgaaatcctccagcgaaggtcagtcatccgctttatttgaggtgaaccagcctctcctaaatttcgccccaggaggtttcacctgaggaggctcctagtggcccaagagccttatcggtctcgcgtttacctggggccaggtgtagtgcctcatccctccctgagccactttcattcttcctccccttcctgaggcctgttcctttggcttggcccaggctgcaggcccatggccccttgggcttaggggctgaagggtcatggccttgaaggctgtgtgcgagagcagagggactcttgccgtgagaacagacaagtcggggtacccccatcccagtcccagctgcagaacttggcgtctggcttccaggagcgctaaggcaaggccagcagcacctctctggacactggggaagggagatcgtggctgtattttccaggacagtgggagttccaatcagccttggagcccctttcgtgatatgtgtgtgggggttttgttgttattttttgttgttgttaattattgtccacccaccctccgtaacctctcacttaattctcctcccttcccccatttccaaccctagggataaggacggagcaggatttctacgtgcgcctcattgactccatgacaaaacaagtaagtttcttgattttgggccacggggggctctatgtcacaaaattcagggcagtcaagaagctagttgctccaccgcaggtgggctgggactctaactctaaaagccagcgggggcggctcagaccaaacttgcacggccttccagtgtccattcatgcgcttgcaccgccgcgtggggatgagggctcgacgcgcgcgcgtccctccaagggaactcgggccttgtgaattaagactgcagggtgctgagtggcgagaaaaagggctgaatttcctctgacccggccagggagccccgaagggctcaaaggtgcccagggaccctggtgcggagtgggctgaacctttgaaacccaagcaagccaggcctccccgggaagcagaggggcgaggggctgagggggcggaggaggggtggcagaggcggcttccccaggaatgatgagatgggctgagagcgcagatgaccattctgcagatttgttttcaaagggaatgatggtgaaggtagtgttgaaagagggagcgacaattgttagaggatattttgcaaaaaccctcctgcttttgcctccaagtttggcaggaagccaggcagcatgagtgagcttgtggtcttaaaggtacatagacggcattttcttaagctcccaacacgcgggtgtcaagcagtatacattaaggttgagttatggtttaaaagatacaattatgagccgagtcagaaaagaggcctgacgttttaatgaggcacaggagctttttccccttcttcttaattttaagaaaaagtttagtttcagaattaagtagctggttaggtagttggaggagttagtagcagaaaaaagaagacagctttattgggtgggggaaagaaattagaacaaagaaaaaagttatccattgtgtactaaccagcaatttagcaagaggattaaaatttatttacttgattgtgattttagaatgtttcctttaaaataagagaaatgattttctttcatagatattggctgagaaagtttcaaattagggtatatatgcatatttaaaaattatttttagatacaccacggcttaaatatgtggtagaaatgtcacattaataagctgttgggcattttaaaaatctaatcttcaagaaccaatttattaacagctatttttgatgatcactttcatatttcgatatgacacaagtagaaagcaagagtatgaaatctattttttaaaataaaaataaatattgattgaaatatatttcatgttatttgcctaaaatatttggctttcttaaaaatctgtttatttctcagttgattgctcagagtaaatcaccatttataatttttggtcttggttttattttctttaatggatttaataattgcataggataattcactttcatttggacactgtgttttttttttttttttgccttccaaggcagaaacacaaaagcctgatttttaataactttttttcttttgcgatgtcaaaataaaaatgtcttaagtggagttttgttttcaaaaattgcctttgataccctggatatcctttcctgccattctcattacaggaaaaaaaaaaaaaaaaaagttgggagggagagggggaaagtaggaactctaagacatactctatgtgtatttattaggatttactttctaaaagataaaaggcacacatacacaaatcagtacataaggcctgtctgcttgtgcaacattgaccaatgaaatattaaattataggtagcactatgaaatgaacaattgtaagaagcacagaattaagacatgtttgaagtgattaatcgctctatgaattaaacctcctcaaaattttattttaagtctctctagtcaaaaagtgccactactaattgattttcccattatgggatgaacttaccttatactcatataaaaatgggggagaatcatcttttgatatttttaaagcaatacatcaaatatcattttactaacaaggtcatagagcttaagaaaaactgcagcttaaggcattctttgaccacttggtgtcataaattctatcaggaaagagggaggaagagagagagaaagagagagagaggaataagaacaagattagttttattttcgataatagcacttatgagaaagtcatttgccataatatgacatctcagtaaaagtcaaaattataaatgcatgcaatgatatattttggtggggagtggcctgagaaaaggttgaataattatctaagtctaaaaaatatcaggaaaaggaatatttcaaagcttacctgtgtgctttcataataattgtttaaccacctctctgtagctttcactttgaaaggcagttcctactcattatccaattgcttgttctttgattatgtgctgcaagagttttggaagtaggttagcttcttgtctacagggttaatacaatggcctccaaaaagcagatagatgagcgtgaagaagcttaactttccctaggtgtgacataaaaataattgatatttagccttaatgagtaaaacagttaattttcctctagcttgaaattattctatcataattaaataccaagtctgatttaaaatttcttgaatctttgattttagtttaatatacagtggctccttaaatcagatgtaagtcttgatataaactgatggattaaatgattacatttttttttcctgtgaaattcttcctcatacattatggattttgataattatttagagtacagaatgaaacacttctggtctgataagttctgataacatcatcaattgtggaaggaatacctagccactgttcaagtgtcttttcttagctgcctgtttattataacatttttcctatcagagatgcagctttatgtgagtgatgtcatattcttgactagaaagtggggttaaaactcaaaaggaattttggacaagcaaaatttaaaactatttttgcattctacatttccataaactgttcttgatcttgggtgggattagcagcattgagatagaaaagaaatgtactcaatcaaccaagatgtgttggtatgacacagtatttcacaccttttcaaagtgtctcattagactattttgggtaatgactcttaatttttggactctaccaggaaagatgaagcttcattagaaatgaatatataagaatctgagatcccttatccctatgccttcattgtaaagcacacaggatataatattttaaaaattcacccaccaactagaaaataagaggcttgcttttgggaagggttgttcaaaaccaagtttagctggactaaaaatagtttgttttcgtgtcattactgtttttggtattccattagtgagcatgcagaatgccctgtaggacccagaagtttatggctgctgcatccagaaacaatatctactgcagaagctcaaatgaatccagtgggggaggtctgaggtttagtgggcatcctttcagattttcatgtagtatttgaaatatgattacattctgtgattgctatagtgagttatatatctttaaatagttttttttaagtttagcttatctcccctcttaccatcttgctttaaaagagtgatattttataattcaaagaaaagataccaaattgtattaagttatcaaaacaaaacactcttcccctaaacaaaagcctgcttgagaagcaggaaatcgtagtcacataatccttgtatgtatggatttgaaagtagatgatgtagtgaggagaccgtgaaaaggttcccaggacagtggggggtccaaggtacaatcatcagaaatgctatcaggtttctcttcgcagctagacttcttgatatatttgttttgatcttccccgtactttaaggtattgatgcaagtgtatttttttcctattgattgtttcattatatcctgccatggctacatagatttgattaacaaccctttcagttcatggttcttcattggtagataaacacattttcagtatatcaataagttcccaaggaattcactaggccagcagagagtttctttcatatatttggggaaataaacaaacaaaaaaggacacagcaagtttatagtcagaggccatatttcagcagctttctctctcctttggtaacatgtcaaaaatgcaggtgatttaaatttccttgcacatagaggaatgaagaagtttggaatttttatgcatgatcaggacctgtgtttgggaaaatgtaaactcatcacagtggaaaatgtgttgtttggagtctgggggtgaaaacaaagctgatggttttggagagattgccggagccagatggcctagtacttccccagtcctggcgggccaactgctccctcctggataatatacagccatttgttcggggatatttacgctagagctgnnnnnnnnnnnnnnnnnnnnatatttacgctagagctgtttccatgtgaatgtttgaacagcattaaaaacgaacatattagtagagatgcatttattgaactcatatgactgtacagatagtctgttctctctgtcttatattgctgagagcgatgaaggagtgtttggacattggtgaattgtctacatagttgttgagcaagaatgatctggttttagtgagcaattaaaatacatcaatgtttggaatcagactaatggaaataatgttagcacctaccttgaagctccgttgtgagaattaaataacttcatacatgttaagaacttagaacagcgactggtacaaattaagtgcttaataaattagatgcttttattattattattattattattattattattattaccccattgggttgacaaagccaattgtatttactaatgtaggtgtaaatgtagttaccataggagtgaaatatcttttatttgtgctagaaaaagaaatacaatatgggattgttagagtgatttagttttttatggtgtttgaataatataaggggttttagctctttgagacataaaagatgcattctaaagctaactgcttttggtacacattctctttttattcagggctgtgatgtaactgaacagcacactgaatctgatatcattccttcgcaactttcctaattcacttctgaaaacgggcctgcttagctgctgagctgaaattacatctttgtaatttgttcaccagtagccaagctgctaattgaagcaaaattatttttttattttattccactactaatgttggattgctgtttgacacgttgtttatgaaatgtcagatttgtagtgtttcctttggcatggtttaatttttaactagtgtgccttcacctactggaaatttctaagaccagattagctagcacctttttttttctttcttttttttttaatgacaaacagtagaacttggtggttgaatgtaatgattattattatagtgtgttgatattgtaggtgtgcatatcattttttgattagctcaattcttggtaatttgctgccaaaggcttgttgacagtttgcattcagaagacatttcacttttggttacagcaggtactttgtgcattcatgaacttattctcttaggtgacaaagtaggtttggctttttattttgtaaggggaaaaaggagtaacatattttcaaggtacagttttgatttaaatagaaaattagaagtctttgttagttactgataacctttcttttccctccctccaatcctttcttcctaccttcctctctttttcttaatttcttttccttcctttcctttcttcctttttcttttcttttcttctttctttctttccttctttctttctttcttcttttcttttttctttttcctcttcctcttcttcaactaatgatgataagtttccttttgtttgcttataaatcaagaaaggttcctaatgaaaatattttgtttctaaaaatcctttggattttgctgaaccaaagtcaaaagtattctcttcaccgcctttattttgtcgtggaacacaaagagttaaaactattagaaaagtaaacacagaaaaaccatgttcaattctctgtatttcctttggcatcctattgaagtgtgatcccggtgtacattcactgtgtattttttcattttactgtgtggtctttacccatagtaagtttcaattaacttttaagacctagcagtatttaagaaaagctagaatgaactacgcttcacagtatgtctttcaaaacagtggcaactcaggcaggtttttgtatattgattgattggttgattttcaaagatattacaggttactttataattgagcgtttagaattgatgatattttattcataacagtgaaatttccagagatgtttttgcataagaatatgcaagtttaacaatttcgatgttttcttcttcttttagttaattattttaaatatcctttaaaagccccttaatctgaagtgaagagagtatcaaaaaataatatgagatattttctttctactcattagagtatgacagcagaaaaggtaggctagtatatcacaaaaataaatctgttccaaatatatccacttttgacagcttgtttgtcaatttcaccaggtttttaaagttgagatgaggttaatgttgtttactatttaactcttcctcttatacaagcattcctgtcaccttaagggatttatttgccattggcaggattaatttaaacattgttttctacttgatattgcatttttgattcttaggttacaaacctcaacttgattcactatcaactgatttacttaaataatatattttatatgatttttctccccctcccacccatctatatagcaggcatcccatcttcacttcagataaacacattgatttatttaaaccagtgttgtctttgtccctctcacaacagacaaccttcctcatagtgagcagactcatgatttactatggaggatgaaaataagccttcttcttggtgtttcattgtctgggccctaaaccagctgtctattaaaatggtttcacttaaaatagccaatgctgtttatatgcttctgtgatctcccagctgatccaaccccaaccagctttactcatacaccacagaggcacatatttaaattaggaagaaacgcagaaacttctcccgaagttggtgttagcaggatccctgtcctttggggcttaaagtctgggtttgctgaactgtggaccagtgttgatgtgtatgctaaatgtagatggtaaaattgatgtagggctatcagttgggtgtgcaagctgcagggagaactttagggcattttgaaaattcttattgttgccactctgcatcagagacattcatcaaaatgaatttattatatattcctatgctggatccaatcaggatgttgatttccgtgcccataccttctgtatgatatgggtacatgtgtgtatgtgtgtttaacaatacttttcagtaacaaaaactgctttgatgaggttagaggtggatctgtctttgactgaattccactctagagctaacctcattacactgagtttttagtttactttagttacaggattttagtcctactccatggtggagtttcacttgcttttatttcagaagtcatggaggcagcacttctttctctgcctttatgtgctgaaaaatattgttctatagaggccccaaggagagggagagaagaaacttcatgcttgcactcctccctagagttcctaactatttctgagcaaatccaaactgatggtttcatttttctgtgcttgatttggagaaagattctgttttgactctgctgctggaagcatagtggcagtgtggtatttggtgaagagctgtatcatggaggcaaagggccttaaacaagtgatattcagtcaccaaagaagtgacacaggatttctggaagtctgtatcatctgctgtttgggaaaaccatgaatgtatttgtattgcagcattgcatccattgaatatcatcatgggcccactaatttcaatggaaccagcagtcttagtgaaactaatatttgcgtcatctagaaagaattgaaataaaaagatctgatgtaactgataattccccctgcctccaaaaaccaagcttttctatatatatgtgtgtgtgtatatatgtgtgtgtgtatatatatatgtatatatatatgtgtgtatatatgtatatatgtgtgtgtatatatatgtatatatatgtgtatatatatgtgtgtatatatatgtgtatatatatatgtgtgtgtatatatatatgtgtatatatatatgtgtgtgtatatatatatgtgtgtatatatatatatgtgtgtgtatatatatatatattagggaaagccccatcagtatctgtgaatttatttaccagcttacttcttttagcttagcatgacaaatatattattttttaaagagtggtggaaccaaaacatcacaaatattaaagctgaaacagagattattacgagtatttagagaacatacaaaccatgtagtactaataggatttagaagaaatgcttcattagagttttttagcatcatgtatgagatctaataagtaatttactgtgttttttaaaatgttttcaggagtgattgcaggaaataaagcaggcagatgtaatttttggttttcaaaacatttttagttaatgcattttcttgagtaatgcaactgcttaggattttgaaaaggtcttttaagaatacagcaaagaataatcaatgcatgctgaaactagtggatgaaaatttggcacatagtaagatattaacacaatctggattacgtctacagaagatagttatgaattgcatagggtaaagtaataactttaccctggggaaacctggctcatgatctctgatagcaagcactaccttaaccaaatggtcagaatttatgttgccaatagtggaactagtcaacaacatgatttgatacactgagaagaactcaaaatcacctctgtgttatccctgccctgaagtatgtaactttaatccaagcctgaggaaacgcaggcaaacccaaattgagggatgttctacaaaataactggcttgtgttcttcaaaaatatcaatgtcatgaaatataaagactcagaaatgttccatattaaaggagacgtgataactggatgcagcattggattttcttttgctgtaaaggacattattgggtaactggtgaatctcagtagggtctgtagattaaattattgtatcaatgttaattttctgatttagataactgtactgtggttatgtaagagaattccttattttgaagacatacaggctgaagtatttagggcatgtctgcaatttacttaataaatgattcagaaaaaactacagagaaaagaataaagcaaatttaataaaatataaacattttagtcatctggtaaaatctggatgaagagtatcttggaattttttacatattcttgaaagttttttgtaggtgtacatgtatgtcaaagtaaaaaaatttttaaaatacaaggtattataggttagccataaaaagtggtttcgatgggccaatggtggagaagtattttttcctcatgcaagtacattttctcattttttattttactgcaatgttcattttgtaacgggatcagataccataaccacagttctctctgaggatctatacacactgggtcgcaagttatattcatcatttacaggttctgaaagtcccaggttcaaaaacaaagcacgttagagtcaactacaagttagtcttgtagcatctctatgtactatataaagatatatatactatattaagatatatgtactatataaagatagtctctggctaatttaagtagttttgtcatcaagaaattgagggctataggaatgtgtgaaagtaattttgttaacaatttgaagccgtgtgatattagtattatgccgtgatacagtgttaaattagataaatgtagcccactgcagagccctgctctgctaatagctgtgtgcattgctttggtccaggtattaacatgtagatccatgaaagctgaggtcccagggaatcttcttggtgtccttgagtaaaatgttcgttttacaaacacattacaaaaaatagaaaaaactatttgggctggtgaggtgatttgggactccagattttgagagtcagttgtaactcttcttagtttagggagataactttatggcttaaatccacacacagagcatatgccagcgagtattcctgtttgggtgggtgtgcaccctgtgagagcacatgttctcagcctgttgatgggaagagggattttccctgattgataaatcattgcaaacatgacacagttagtgaatggactccttagttcacctacacttgttttctactacccatccctggaagactaaatgttgagcctggaagtagtaaagtgaggaggcaaatacatatcatttaaaaatcaaatccaaatgcttttctgtattttcgctaaatagtatctcaatctgctaagccttctggggtttccctccttattgatgagatttatttgtattctatattaaaaggagaattgtggctgtcttgcccatctcatactctgatccagagatgagcatcatggcaaggtggttgaaggggcagagaggaacatgcctttcaggttaatcccgaatatcataccttcagacgatcaacccagtgatgtctttggctcctcaaagctaatttggccttcagtagtggtgaagtggttaagaactcaattgtgattttttttttttttctgctactcctttccattcttagctaaaactgtgcttttgcttttaggccatagtgtatgaaggccaagacaagaacccagaaatgtgccgagtcttgctcacacatgagatcatgtgcaggtaagaaatatcttggtctctcccgttaattagcaaagagaagatgaatttgcatttcaaatcttggtgaactttggtctttttttttttttttggtacacatttgtcttgcttctatagacaatctaaaaagaactgttagatgtgagtatttggtagtaaagtgtcaggcatcacagtagttcttaattatttattagatttcatcccgaaagacatacatttccattttgatatcacactgttaatgggcacaaagcactgccttcccctactctcttaaaatcaaataaaacaatataacccttttagtgttaatatatgcgctcaactgcattgctagtaaaatgagtaagagttctattgatgtcagcagagtcttctgtttgggtaagacttgaaagttatagttcccctttctaattctcccacttgaaaatatgacgtccacacttaggcatcatttcttcttaaattgcatgtgggttttttttttcttcctcttgcatctcacctcttatttaccctatatataactctgacaatgtagccaatacttcgcagaggtagtgagcttttggaaggaaggcaaagatgagtccctaaaaggcataaaattcatgtgacccatagatgagtgtctttatttttgcctgtaatcagactgaagctacatttgaaaacaggcaagtagaccaaattaacttccatggcctcagccaggctttccacatgtgagggagtaggccagggaacagccctttaacttgcattcttattctgcataaagtaacaccagcagtttgctcccaatatattctgaataattggataaagcatgaagatgccactgtgcatcagagaaaggctactaattgctttgttaaccatgcaggctcttcctggcacaatgctggcctggctgctgactattactgaccaatccgtttagggcttcagctgctgcctcagcatggatgggctttatttgctgcttgtggacttgtgggggaaagcaaccttaaaactctacaggtggaaagaaaaagggcttaatgtgctttctgagtgaaatcccaaataccaacttcttgtatgtctacagttacgtatggatatacaattttcattttttcccttttaaaaatatttctaacatattattctaaaatatataggagtttcacaagttttcatttcagtgatttgtaaaacttgttaactattatgaaaataggttgtttttctctaattttaaaacagtagcagaacccccaaaatatggcaatagatttctttataagatattattaggcaaaaattaatgttatattgtacataacaattctacaataaagctgagttgcacctttcagaattgtgagtaaaattcattttagaaaatgttaaaacatgacctctttcttcttactatctttttgaccatatctctgttctggcttcttacaattagcatgtcattagaatgaattttccatgttgtactacatgtgattctagcaaaataggaaacagacaggaagatggatctcaaccaataggccaaataacatctatatatcatagatttgcatctcatatctgcacatgtttagactatgctagaaatcattctattcttgaaacatttaaagatatattatgcctttcacacacaggcctaccctctattaatgcagtttatatttttcttgtttttaaaattcactggtccaaagtactttattatgctggttggtgtgctttactgctgatgttctttctatttttcagaaacataaaaatagcaaaaataaaattctgaagccactgaaggcaaatgatgatgtttgtactgcgtggctaagagggaaaagccgtattcaaaatgtcatcctgctaatgttacagattacgggttttcctggctgcctatagatgtataaggggtactgtttgtttaccaggctgccatgaccctattacacaaacctgtcatctattgtgtggctaacagtcttttaaattgcaaatctgatgctctttagggggctttaggaaaaaaattctcactttccacaccatcctatttctcttgatttcttgcctgttttaagtggaagttgggatgtgctgaatttgcaccaggggtgcaaatgcaggctcaattataagcataaaattagagtctgttccccattaatcaggctggctaattgctatgcaccaccattagccatatggtgtgaaagacagcttgctctccccaagatgaaatttcttcattgcagacatgaaatagtgagggccctggattttaaaatagcttgtttcagatatttaatttctaaacaactttctgcagtgctttctatcaaagctaacggcacaataaaactttgtgttgatgtcatgaaagctgtatatttatagtatgttggctatggtgaaggagacacagagaatttagatcgacaagacaaggcttggtatgattctgttttgttgcaggcaaagggggaaaaaaaaagaaaaaatgagaaacaccagagaattgtgtctcaggtggttgcaaatttttaaaatccattgtgttctgtctgaaaggtgaccccactgcctgggctggataagggactggccaccattggatcatattataattattattaccactcagagacaaagcctctttgactggacatggagctctttctgtgaaattctgagagagtctctgcctgtttggtaaattggaatctatcatatcaatcatcattacattttgctatacctgttggctacgctcttaaaataatacggccccacacatgattttctaaagcacgattctagaagagatttgattaaagggcatcctgacatcctgtgtttaaatgtggatggaaaataagaactatgcttggtcagtgaacctagttcccagagctctgtttaagaaagacctctttccctcatcagtgtatggtttcttataggaccatgagttctcagggctcccttgagttcccttttcttcctttctctgttactggcttattctgattccatccttcagattcccacttaagcatggcttcttcagggaagcatccctggctctcagcctgagtcaagtcctattgttacgttgtcctgtaaacagtggtcctcttttatccatgaaggatgtgttgcgtgacccacagtggatgcctgaaactgcagatagtcctgaaccttacatacgctatatttttcctatacatgcatgcctatgataatgtttaatttataaattagacataataagagatgaacaacaattagtaataaaatagaacaaccatgaaaacaaactgtattaaaagctatgtggatgtgatctctctctccaaatattgtacagaataccagccctttgggaggccagggtgggaggattgtttgagcccaggagttcaagactgccctgggcaacatagtgagaccccccatctctataaaaactgaaagaaaaattagccaggcatggtgcatgcctgtattcccagctactcagggggctgaggtgggaggatcgcttgagcccaggagatccaggctgcagtgagccctgattgcaccactgcactccagcttgggtggcagaacgagaccccatctcaaaacaacaacaacaaaaaaatgtactggaccacaggtaactgaaaccatggaaagcaaaaccatggataagggggactactgtctgctgtgcttttctttcatagcactcagcacatttgtaactttttgcccacaatctgtcttcctttgctggactgattgctttttgaaggcaaggaagttactgggtgttcctctgtcttcagttttcgtatttctgaaatagaggataatattacttatctcagaagttggtgattaagattaaatgcaataatcaccacaaatgcttatcacagtgcctttacacacagtaagtactgaatatctactgttattattaatagtaggagtatttgtattaatagaagcagtaacagcaatatttgcagtgtggggctaagtacttggtgcgcagttgtttggtgtgaatgaggataaaagaactttgaatcaaagtgaaatgtctaccaaaacattcatgcactttgttcattctagttgtgggagttaaggatgttttcatttattcttttagcacctactatgtgcaaaacactcaaaaacggagagccagggaagactttgttctgtagtaggggagcttatggtgtggcctgggagatgatattggttggcagataacgagactgcactctagaaagggttgaatgtgatgagaggttgaggcaaagggctatgtctattcagagaagggaggaaatacttgtagttgggtagcaggaatagggagggggattttagagggtgcatgaagtgtttgggcacgtctgtttcagtccagccaaaatttctctgtggagagtcctgcaggtggatggtcctgagttctggatctggaaataaagttatggtcaaagataactgacttcagaggtcgtttcccaagggtgagagttgaagctatgggcttagatgggattgacaagggagggagaatagaaagagaaggcatggctatattcttggggggaataatcacgcttagcaagaaggcagggtgtgttagagagttcagaaaaagaagcttgagcatacagagcatagaaataaaaggaggaggtcaggtacggtggctcatgtctgtaatcccagcattatgggaggccgaggtgggcagatcacttgaggccaagagttcaagaccagtctggccaacatggtgaaaccccatctctaccaaaaaatacaaaaatcagctgggtgtggtggtgtgtgaacctgtggtccaagctactcgggaggctgaggcacgagaatcacttgaacccaggaggtggaggttgcagtgagcagagattgcgccactgcactccagcctgggtgacagagcgagactccacaccatctcaaaaaaaaaaaaaaaaaaagataaaaggagggtgtttcaaagagggggagtcatataataagtgctagagagatccagatggacatgaaggctgagaaagcaccagacagtcactggtaaactttaagaggagattcaagtacatgctgagggcctggatgcccgtattatgtggttgaaatggcaagtagtgacagggactcttataagaaggatgtcggcagtgaagaaactaactcagagaaaagaaggagcatccttttaaaattttagacaatgggaaaacttgataatgtttgcaaactgaaggaaagaattaaccagggagggaagaatggcaaatgcaaaacagaagaggagtccttggtggggctggtcccaggtaaggcagaatgagacggacctgtgagctcaggtacttgagttagtgtgacgaggatggatcacttactttaagacatgggaggaagagagaggatagaagagcctattatgcaatggattctttaaaatcaagtcatctttataactattaataagactattcagataaatcatagatctcagtctctagccactttagggaaataggtaaggcatcttgttttttacaagtttgaaatgatgctttcctcctgttgagaaagacactattcataggaaaaagttccatgtccctaagatgaggatctgccgattccatgactgggaatatttaggtgtttcttgctctagtttatgaagctctagaaatacgccacctgtgttaggctggtaagaaagagactcataagttcgcttttctctggatgtgcagaattgtttgggagacacacaatcctgctgaggaaagggctgctgatttcggtccgtagtgtaggtaccacaccaggtgctggctaccaacgcctgagactggccacattgttctcatgtcactggggttgcaggttcggaagggatgtaaacagtggcctgcttttaaaatcttaccctggcagcaaagcaaattaggaaactccaagccttgcaagatgccagcatgagagagcaaatcccaagtctgtgcctggtacagtgcccaacacacatcgtaggagcctaaaaaatagtgctttgaacggatgaaggtccatcagtcacacagtaatgaggacctaattatcattgtgatttcttttattaacactgtcactttttccgttaagtgcttttgcatctgtttcatctacggaattgtttcagtatgagccctcttctgccttaaacataagtgaattcattctcctttcagcttttccttcctggtttcctcctgtgtatagtggaggttggtgctcactcttggtccttctgagcttagcagaaagaactatgggcagttctacctgaaaagggagaactcacatgggcaggaaagagcattgtggcaacaaaggagaggtcctcactctgctcggctctaggaagccacagggggcttgatatcagctcagtctacaagaagtctttccttccactgcttgtggttgatttttaatttttaatgtaaaagcatattgccatataaagcagaacactagcctgggcgtggtggcttgcacctgtaatcccagcactttgggaggtcgagctgggtggattgcttgagccagggaatttgagaccagcctgggcaacatggtgagactcagtctccacaaaaaatacacaaaattagccgggcgtgttggcatctgcctgtagtcccaactacttaagggcctgaggtgggaggatcgcttgagccccaggaggtcgaggcagctgtgagctgagctgagatcacaccactgcactccagcctgggagtgcaaaaaaaaaaaaaaaaaaaaaaagcaaaccactgcaaaaatataaaaataaaatgcacgtcttccattcttccccactgcctgttccactctctataggttaactctttgaagttcctacatttaaaaaatatttcctgatggcatactgtgtgccaggctcagttctagttgctggggtctatgactgtctttgtggggcttatattcaggtgagagagacaataaaagacaaatgaatataaaatacaacatggtgagtactatgaagaaaagttaagcagaataaggagctagagtgctctagggcagtcatttctttcttttttctttttgagacggagttttgctcttgtcacccaggctggaatggcacgatatcaggtcactgtaacctccgtttcccgggttcaaccgattctcctgcctcagcctcctgagtagctgggatcacaggcacccaccaccacacccagataatttttttaaaaatttttattagagatggggtttcaccgtgttggccaggctagtcccgaactcctgacctcaggtgatctacccaccttggcctcccaaagtgctgggattataggtgtaatccaccatgcccagaggggaaggcatttctaaagccattgacattatgcagagacttgaatgaagtgagggagtgaaccatacttgtaaaaactgtctcttcccctccctctctccctttcactctttcatgctttcatttttctcccagaaatggggccatactttgaatagtattctgcaacttggttttctcaagtcacaatatgctgtacatttctttccattccagtgcttctaactctaccttcattctttttaatgctgcacagaattccatatacacatgtatgtgtacacacacatccatatatgtacactcatatgtatgtatgtacacacatatgtatgtgtgtgtgtatgtatatatttaacaggatcatactgtagacattattttgtagcagacattattttgaggtgcagaacagaagccggagtagctcatttcaggaataatgactatgtgatgcagtgatatgacccaagaaacaggagacatgttgggcttatttttcatacttggcctaaagttttttttgtaagtggtgagtgaactccagccctttattcttttttctctacttttcttcattctccccatttcatttctatatttccttctacacttctgctctttgcatctgcctatttccctgggtcccttagaaaggaatgcttcaattcatctggctgctctcagggacatttttatttttagatgacgaccgtgcttaagtgaaaaggaaaaatctcaggcctggtgtggcatgcttgggggaggtggtttgttctacgggttgggatgaggtgcaccttccttccatcaacaatgccttggatttatctgtcacccttttattcttccggattgtatttgccccccaatacataacattcattcataaaattattcatttattcaatcaattaatatttgagcttttctattctaccccaggccttatgccactcattaggtaagtaaaattgatagtttcttcctctacgaagtctatgagttaaaggaagagaagaataagaagagggagaaagacagtaacaaaaaatacacacacatatatgtaaaaatataatttgcattgagttaagtgccttaaaaggaaaaaaaaaaacaggaaaaacctaatttagattaaaggtggggtgtcaggccaaacctctctggggaaggagctataggctgagctctgagggtgagaaaagattggctaactagggaagggttggaggagaggcccgccaggcaagagtcggccagggtctgggcctgaggtcagattgaacagggcacaactgagagggattgaaatgggccagtgtggtaggagcttggcaagttggaggaagggggcagaaggttgggaggtggtctggtatcatgtcatgtcatggatttgttctaagtgcagtgggaagccattaaaaggtcttgggcagtgagatggcacagtaccactgacatttggaaaagctcactctggctattgcagggggtcagagtggagacagaaaagtaggcagccactgcagagtccaaggacttggatggagatggtgtagtgggggaggagaaaatcagataggctttaaaaacagacccttgtgcatggttatcagcaagcaggttggaggagttcctggaggacatttctcccaggcaggtctgtgggcagcttgcattgcctacttgctgttttgaaaaggaaaatgaaggagaaataggttttctcaaccggcagttttcctccatgggtaaaggagacgtgggctctgtcgatgggctgcttttggagacctgctgcttctgcagagcacagggcagatttgcctggacttgaaggaggaagggactgaagagggtaggtgcagggggtgataatgatgcttcattgtggctttagtgaggctagtcatgaagccaagtctttatacccttattgcctcaagcctgttccctggcatttagaggtagatactgcaattgctccattttacagatgaggaaactgagatcctgtgaggtggattaccttgctcaagttgagataggcagctctgtcagatttcagaaccagtgttcttaaccactatactattctgagaagcccatgaaatgtaggtataggggatcagagttcagggatgaaggagttatatttttatgtattttctggcatgcatttcaactgcttgtactttccactgcttcaactacttgttactttatctgtctcttagatatcatgatactttggtttttccatcccaaaagtagcagtatatagcagaactcaggcctggaggaaatagttccctctgaatcagaaggtgaaaggctataaggtagacagagtggttttagccgaggctttgacaaaggagatacagttcttactcttactctccgaagacatgaaagaaaaacagaagacacttaagagtggagactaattctcttctcagaggcatagttatggcaagaaaagagactttccaattttggtgaaggactccctacgcaggagtatatttctgggtcctgaagatgaagttcaatatttggttctctccagcagccctctaaatttaggctgtatgattcactaagttgtaagtgtgcgcgtatgtgtgtatctctctctgtgtacacgtgtgtgtgtaagagcaagaagtgcatatttgcttgtggtgcttggtgaaatgtaagttttggaggacctccctccccatctacttcactgcttttataagtatgcccctggtgcagatcttgtttttatttgcaaacaagtttcagatggatcgttttctgttgaccattgtacttttcaaaaacataaaatgttcaccctttagaaggcatctcagtttttaaaaaactggcagccacaactggcaggggagattttagtaataggtacttttcgagcccataggctcttccttctctaacataaagagcgtcctctcacagagctgtgctaacctttacttccaatgtccataatgcccccagaaaacttaagtgagggtcagaacaggcttttatagccagaggaatgtgaatctccactttcttttatcttgccccttccttgtcttaattattgtgttttacctttattctcatgaaaatggttcaaaagcaaacctagctgtaggatttttggaaaggctgtggttgaaggaaatgctacccataaaggagaaaagagaagaaaaaggaatccatttaatacaaaatgactggagggggagaaatcactcatacctcattattgatgcgttccacacaattagtgtgatcttgagggaagaacgtttgagccacccacaaccttgaatattctcattgggtagatgcaataacagtgcacttcacagtgaactctgccagcaccgcgggcagtcatggggagaccccatcttggggttctgagtcttggctctgggagagcccctctcccccacctccttctttgagcagggagaggttaagcctggccattaacccataggtgacccaaatagaattatctgtcccagggatccgttgattgccaggtatggctttgtggtaattctagcatttgcaacccagcaatttgagccttctgtctgcctaaatgatgattttacattgtaatggttgtactaaatcctttcgcttttgctccatagccgctgttgtgacaagaaaagctgtggcaaccgaaatgagactccctcagatccagtgataattgacaggtagggaccactcttctttcactggattcttattcctcattataatgaaacacctgcccttgtgttgctcatgggcgagggttaggaatgcatgtggctgaaatttgcctgttggtcatgacttacgctgtgctgagcgattttgattcctgggaaagccatatggaatgttcttttagaggcctgttccttggattgctccggtttttgtctgattcatgctcctaaaggaatatattttttctttcctgactttctgtggctcaatcctcatgctgtgccaggaagcttcagaaataaaataataatagtttgtgatttatgaaatgtggttgggtgcttataaatatttaacttttatttgaaaaatgtttgaatcattatcacttttagctacagtagttctgttggacgtaatccatctacactttaaggttttatttatgcataaaagcagtttaaagagatctgtgaaccaagattttctactgttatttgccggatttgattgcagtatgagaccatattgtaagttgattaatttatcctgcttgtcttaatttttgtgtttttaaacagatccatattactaatctgacatgaccaagtaaatcaccgtagaacaataaatctgttttagttgttcggtgtaattttgagtcagtgtgcacgcattatgcaaagtcgcattccaaatattcattttacattttaattattgaaattcattgtatggaaacatgtatgataaaccatttgttacatagcattactcattgagagttaaatggcctggaaggtttatagatactgtcaattgtcagctaggaaaagagctagcatcttgtactagctggaaaaagagtcttgccaataagactgaccgatccctcattgaggaaaccaatggttgaacacaagtccctttttgggtttcagcaatattgatttttgacaacaacaacaaaagaaaaaaaaacccatctttctttctaccttttttgggcttgttttatcatttttcagttaacaatgacaacaacaaaaaacaagatgtttacttcgcttcaacataatttatgccaaaagatcgattgttgattttgacttatgtgagtcttcaggcataaacccaattgattgccaagaagctttataaaggttacatttcaatcagatattttaactaaatattcctcactagtattcactaaaatatatatatttttgctccatataagagtattagtatatttgattcaaagttaaaagatgagaaagtttgacatatggtgatgtgtgtgctacctatagaattaggataacatgtttatctacaaaagcagatatactgttcatatagttgctttttctgtgattgaacataagtctccaaatgaataaggtcacaagtaaatttaacctttatgctggtttgttttatttaaatttacctctccaaaatatcatttgttattttaagcatttttcttcctcctctgttgaaaagaaagtgtacggatcaaaggaccagcccaaatagtccccaaaactttgaaactataagcattttgttctgccatgtagttccttttggtttagatgatgacaagaaccttaccttgccaccctcaatgaaaagacttttttttttttttcgcttgtgaatgggttaagcttttaagttcttcgtttggtttgaagctgtgactctgatatagaaggttgatatgactgtggtttgaataacatttgattttgacctgttcctgtgggttgcgatggcataagaaacttgactcagcagcactgtaattagcccggcccctgtttttgaaacaggattgtgttacctggattgcattagtgtggcttctattgttgccgctttgcatctgtcccagaagggtacttaaaaccttttcttggctggggtagttcaaacaatttaggcaaaataagtatgcactttatgctgttggtggctttggggatattactcatgacatttatccttttcattttttttcccttttggtttgacaaagtagaaaacagtgtgtagccaatcttggtctcttcagataggagtactttaaaaacagctgaaactcagtgtatgtgcacaagccccacagcatatgtttattcgctggctgttgccattgtttctgatgaactatcttttcatgcagtgatgccagttgatatgcaaaaccccatttagctatttttatttgcacctgagttttcagaatttatttgtccttcaggctgccaaaggttttaaaagctccagtcctgtctgtgctgatatgtgaaactcccattcttaacagcgagagaagagaataacaacaagagaagaacttatgcaagaaagggcaaaatagaaaagatttttcaattccataaaattgctgcaaaggggaaaaaatgatggcaaccgtgtttgaatttcatagtttccaatttgattctatattactgattgcataatatctgtgttacgtgcttagggtttgatttgctttcagatttatggatgcaaatccctgaatattttgtgaaaataggctatgaggcctgcattcagtagcaatagtaactgttttcaaaagatgcatacaatatgcaattacagagctgagggtacaggccatccttgcgttaggatttagcatagttttaacacgcagtcaacttttgagcaccaataatttttagctctctttgcttgtccttcggaatttgggagaacactactatttttatcagtcaaaagacttttagcagtggtttattcaggaaaactatttatagggtagagagaagagactttctggtcatagtgcaatcgtgcagggcaagctatttctgtgttaaattttggctgtattatttgctgccactgactttgggacatcagcctggcatattctatcaaaaaagtagaattaacaaaatcagcagttgcaaactgtgatttagaaaaggggcttctattatacttcatccttatggcatgcacagactgagaaacatatgaccccaattctttttacaatcatgacaatttgtcaagtcacttcaaaaaagtttatagaaaaattgctgtaaatgcaggaagtgcacatctggagttgaatgccaggttacatttctgtgtggtgccaaatagcttgattaagaagcacataacccagcctgcactcagtgatccagatatttgagctgcatagacatgggaaaagtcaaatgtgttatgtttaatagcaaataaccaggaactgataacagcagatttcattatttttgaggtaaagggctatgtgtggtaattattgttaaagtaaaaagcaaaaaatgacttccagttattgaattaaggtggagattgattttacatattgacacagtaactaatatttgaatttaaaaggtttgcaataaacttcatgtttagaaattgaataaataggagttttattaccacattggatatccttgtgtcctaacctttttccttggagttatcttagttcaataaataaaacctcattagactattcccatttcaacgagtttattaaattttgcaggagtaattagcataagctgtgctaatttttctggaagactaatgagggaggttcttaattaggtttactttgtaagaatcagaaaagatgataatgacaaaagtcacatagggtagtctgaattgggaacccagtttttctgcatctattaaaaaatctttctatatggaaactttttaataaatgtcggaactgaatatattaagtatgcagactgttattccatatctggttaggatgaccattcattcttaatttgcttccccaaactctttattttcctaaactatctttgagcaatgacatggatgaatacagatggtcttataaaaacatttctttctccaaagtatgctggaggcttcttttcacacagactcctgaagtttctggctagatttctgttgcttatttgcagtggggtgggatagggggcagcttaatgtttgtttgtttgtttgtttgtttgaatttagaattagtgcaattgatgaaatgaaccattaagtaagggtgacaatgtgagcatcattccttgtgcaatgaatccttatctgttaacaagtggatttttttttttagtagatagaaatactaaaggatgaaattccatctcaaattatgttctcctattggtgtgaatttagacctagttttttaaggatataatgtagctccagtaacctaaaagttttgggttcctcaaagccgatatttaaaacttggatgttaaaagcttgtcaacttatgtacctgtaagaattttgagtttgtttattgtaatattaacagaattaccatgcctttttcccccatttttaagaattcctgtatctatgtgtatggctatgggatgtaggccttgacatgtgacataaaaaaaatacacaaattttgtaaaatgaaaaacctagtctgtttggaattacttcgggtcacacttacgcaagggtctcctataaaggaaaaaaatgcctgtatttcttttttccagatttgtctaaagatcttccacatctagatcacttccatttaggtaacacgaattgggtttgttttatgattatctgaaatagaatgttcagtaatgaaaatattagaatgcccatttgcctgttgattttatatgatgtacatcatatgaacggaaaagcttaaccatgttatggttgctcagataaacaagtttattgaagactcattctttttctaagaggtgtaaattctgtggtaagacttttcagaaaagtgcagtgttgccttatcaccaagctaattttcttcattaaattgacaccaatgtatttatataacatatatgcccatatgtataataggaaaacaatataaaaactttagagttaggagagatctatctatctaaccatccatccatccatccatccatccatccatccacccacccacatactttttaccattgggtcgggtgtggtatgtatttgccaaggattgtaaaggcatctgggcctttcaacaatcaatggctttcctctgtcttttataatcagaggtaaattccaatatttatttattttttgtcatccacataaagtcctcaattaacatgaacataaatatataattttattaaagttgcaaatgaggcttttagttagtttcatgatttcatttcaatgccctttcaactcttcttattttggtcttcatccagtttttagaaggaccaaccaccaccaatgcataatcattctgcactatacacaaatggctgtgtggggtatgaagaaccagaggtgtaaatgcatttctcagcgttccgataaaccttttataccacctgatttgtaaccttgactgcttggttaaaataaaaggaggaggaattcactctctaaaattgccctaggcaggataattattgtgtttttggttggtttgagaggtttgcattttttcaaaagtgaaaagccagcattgacactgagcatgaatttaagactgtttattaaccttagtgtgtttaaacatttgtcttctcagtgggaattcatatgtgattattagcgatgagacttatgtgaatgagtatcattctaaattttatcacatatcagataataccattctgaatatgagatgagccccgtacatttgtgtgcagtttgctaccgtgataagaaaataactaatacaataagctaatcgcagtctatattccatttgctatcagctattcccaaatacacaaccaggatgcattaaaatgcatttcgaatacgctgacaatgtatcataatgcaaagtacttttacatggtataatactattgcagacactgtataatgaacaacagtggttttcctgtaaaggaaataatggcagcaacttccaagaaatgtatttaacggagcttcagagaatcagtagtgtgtatgtgtagcatggcccgggtatcagcccgtggtgtaggtttttaatcccatgtcatcataactttgcttttgtaacagttctggaaaaatacagaaaagcagtacgaagtcctctgtgtgtcccattagtaactatgcacaatcattttgtaatgagaatatatgagtatattaaacatgcttttactttcctaaaagaagttgcttagaatggggggaaaaactctctccaagtgtaactctccattgataaattcccctcatttcctcatttccctctcctgccagcacccggttaactctctaataaaaattgaccagatttaaaaaactccatttagtggttcctgcgtaaagagatggtattttggtcactttaatttgcatgagatgttatctgaaatcgaccactaattcttccttctcacagccccccatcccattcctctctttacaaaccgcgtaactacatactatccaggacaatataaaagtgacctcaatactcctattgcaatcaatgaaatatggtgaacagtacaggtttgtctttcattgctccctgccttgaaaggtgtgggtagaggaagaaaaatctcccttacaaactatttctccagttacaagtctttgtccagaagcaaaagaaggttttaacgttacagtacttattctaatagaattttaattgccctaatcctgctaaagtgtgaagctgagtgtgtgtgtgtgtgtgtgtgtgtctgtgcatgtattcctaatagggaggggagtcatgcaaaaaaaaaaaatctttgttacatttttcatgggtggggcagggggtgtcacatatgttaaatgatgcaaacttaattaaactgattctggggaaggacaggccattggcgttccatctatgaaatgtgtactccactttcggtgggaacagagtggtcttctgtgtgctttgggaatttctatttttgaaagtgaagtgcttggttccagttgcaaacatgccctaaaccctacttgtcatgactgagctagacatgctggcaaattatatagattgatcctacacaataacctccaaaatggcacttggtaactataccatcctgctaactgtttgaggcacaatagttttgtaatataatataaagtaatggtgttagccaacacatctttaataagatattgttcgtgcctttgccatatgctacagagcagcctctcactcggtgggccttttgattcctctcaataagattatttcaaatactctaatcctgaatcattgacatgaatacaaaagcctagtgacatctaatagatgcctcttagctttgcttttcctcttgttcctttcctttttcttctctttttacctgacaaaaagctcatagacacttgggctctgtctctcagtagcagcatggggggctcctcatgaaatataaagggggaaaaaggactgacagaggcccgataagctacagagtgaagggccatagattaaaagtaaatgccagtaaatcctaccctgtacactcacttgttcttttattgttttctttaacactttcagagccagggcagggaaaaaaccagaaaatagtaatcaagctgcccatgtacatttttaatctggacactgtcactattatacatattttatggggctttggcgacattctcaaattttggttcatgtaaaggttgtggtgggttttttttttaatgtccttttaatcaatatcaagaatccctcaagaacttttttgctcatttgctgctcaattaacttaatattgataccatgtgtgggtaggaagagcccttctgtagggtgtgaacactggggctcaggacatgacatcttcaaggctgaaataactttttttcttttcttttttaattgatgaattgaaaattatcaaagtaaaatgatagggtattttgtttcatgacatcagctgctgctttttgatgtggtgctgctccccgccagtgccgtgaattctccgcctttgccgggtggtgcacgcgacttagactctgctggtgcatgccgaggagtcaggagcccagctgggtaacttttctaatggtcaaaatgttgttccctcctccaccttcctgaagcaaccatgatttgactaaagctctttattactccacctgaatatcagacagtcatgctgcttgcaatttatttattgttttccagaggtaaactactgagattttccccacctgtttttaatgtgcttctcgttcataagtattctgatctgttagtaatatctgaaaatatcacttttaacactcttgggtgcactattggctgaagccccctcacagaatggaaagttaatttgaagaactatggacctgcatcaggtttagctacacacaccacacacatacgcacatacacacacgcacatactctacagagaccaaaaaaaaaaaaaaaaaaaaaaaaaaagatgaaaagagagcagtctctttttcattttttaaaaagttctttagaaaagaaagttggttaagggttcacctggttatctttgaagctgttaccaacagttgaaaacccatgtttctctacacagtcttgttgttttcctaaagccagattctaatgttagatatatgggatatgtctcagaatatggttttaaacactgagttgttcttcctgtagctgtagaaatgggagtgccctgatctggctcgtaaagaccagcatctgaatcctggtctatgagcaccttaaaacaaagcaagcaaaacccctgatcactgtgagtttaatagtagcttacacctaaatggcacttccagcgttttagagcacgtcggggtataccatctcagaaaattctctttgcacaaattgactccatttgacagatctgtaaactgaggcacacagcctaaggaactatccactttattggtgacaaagcaagtgattagaaactccacatctcctatctcccagactgatttttttcccttttctcaattgctcagctaaaaacactgttttcagtatttcataatgtctcttttatttcatttttcttgctatccacagcacattttcatgtattactctaaacctatttaccaagccagctttcttagttgatgtcacaattaactttcaggattttatatgtatatatacacacacatatatataaacacatatatatacacacacatatatgcatatatacatatgtgacactgtttattgtactcattgctggagcaatgtttgagttcttatgtcctcatttaatttgattgtgtatttgcttgaaaaaaacatcagtaatccatacagaaatctgggagaaggcacagtatgatggcaaaggcatagattttggagtgcattggctaagggatccagttcctccacagctacttattagtagctgagcctcagggggctcagttttctcatcttcaaaatgggaaaagtcacttctattttgaagcgttgtgaggattgaaacacctagcactgggcttggcacataacaggtgcttaaaatcaggtagctcttgcaatttgagcatcatatattccatgtggattttcattcttaatgtgatcattgccatgggacttcctttgagcacaattaccttactgaagttaatcatggtagctaagtctccttagataaagactcattcattgttttgtttccacaaatatttattaagcctctattatatgtcatgcactgttttcagggttgggggtataacagtgaaaaagacaaacatagttcctggcttcatgcagctttctcagtgtctcagggttgatctctgcccccagtcccccaaaaatagttggaatagtaatagcaagtataaacaaagaatatattgatatatatgttttaaaaatagaagaatgccattttacactgggatcatgatgcagaagaaaaatatccccgggttaaagtcaccttttagctcatacccagaggtatcgaacttgggcaaattccacggctttattgcactcttctgaggcagtctacatgttggttaagactgaaggaagagatctctaagaccctttccaactatggaattctaattttagctgtttgtggtattgctgagcacaggcaggtagatgagcgctttggagggtaggttgtaagcctaagagggcagtgactacgttgagcacagtgcctccctcctgtgtactagatgcttagggcttgtttttgtgaaaagaaggaatgacaggaactagaaatgcagttgttgaatctggtggtctcatctctctgtctaaagacaagcttgttataactacacaataaagtgaaatggcactgccattaaagaatgatgaggaacagaaaatgtaagataaaatattaaatttgttacacttaaaaatgttaatcttcacacgattaccatgcaaatctcctcattgcctaactgtttaattgatcaagtaaatcacagagcagacaagtgaaaatctctgctgttgacattctcacaaagcatattttcaagaatatattctattaactatgtgtattacacatgataatgggaatttcttattttgtaaaaacatatatatgtggcatcctttgcaaaccaccagatttcagagagtttgggagaaggcttgatttttgcagggcaaaaattcagccatcctctattatgtcaaacgcgaaatcagtgttagaaagacccctgtgcaagcagcgcctttgttttatatactattagaagacttcagaattcaccagtttttctttcaggcaggtatagcattgacctgatactctggagattgaagggttaatgaattctctttccctccctccccctccccaatcttcctgtcccccacccccaatcccatcatgtgcctggttgactctgaaagaaggggcttgaagttacccacagggcatccctttccccagccttctccaaggccacctgggcagacgggagcttgccttctgtccttaggacacaaaatccaatcaggcgcctggcctgctagtctctctgacctgcgagctgggaagagggaggagaagcagaggccctcacatttgataggctgcatctttgtggctttagggggctcctgtgtctactcgaggaaggaagttctcccttattttaagataaggtgtcattcatgagagcaatgtgctgaactaatcaggttaattgagaggccgtgagtcgtcctcattgagcccatctcttcttcctgttaaaggcagatagcgcagacagacagattacacatattttagttttttcccaaaagcttatgaaataatgtaggcaggcagggaacgtaggttcagctgaatgtcattcaggctatttgaacatggattcttattgtagaacaatgtagcattcaaaaaataataaaagaataagctctcctcaagattgaaagatgagtgtctctgaatgtctgatacactcttttttttcttaatattatattaaactaacctcagcatttcagatcaactaggaaagaatgtttgttgaagagtccagttagattcctccgcggctattttatttaggattgaaacgtaaaaaaaaaaaaaacaaaacaatctcattgtgatgtgtcatcagtgacaagtagcttcttgagccatgtttcgattcttcggcttccgagccggacactgggggccgtcgccctgactaatcgcatctcggacctccctctggagcagccgagtggggaagaaaacagagctgtttcaactgaattccataaagggcgggggctcctcctccctcttctccactcaaaatgatttgtcatagtttaattttaaacactatcattgactattctttctttctaccccacctctttccacctttttttttttcttggaagttccaggaatgactttaattatctccacaatcaaattctcgttgctgcctctgtgaaagtgtgcagtcatagatggcagggattattttctttagcacttggggatacagaaaccggttgtttcaaaatgagaaccagctggttccacagagcccttatttaatggggagccactttgtacacaaagcctttgctcaggtcagtcattatggcaaaccccaaatcagcagtgttttgtctatcaccctgtattaaatgtcgagcgaggagtgatttagcagatatgataataataataataataattaagaaatacccagcacaccctgcatctttaattttgcctcaactaaacactccggtttggaaggaacatttctcaaacttcttcctacagtgattacaatcatagacctagtttaccactgctctctcatagatggctgaggggtatgtgtgtgtgtgtgtgtgtgtgtgtgtgtgtgtgtgtgtatgtagctttaaccctctctaaatctagaaaataaaattaagctcatctttcaacataatcttttatctgacaagcacagtagatagatgaaaggtagatagccaagttgtgggtccccttaatagaaccaattggagggcagagataactgctattatcaaacatcttttatgccatcctgtaaaataaggacgagggtgatataccatatatattttgctgtctttctagcttgtagaaattggtttgttgtcataccctgttaatctctaacagcactaaattcaatttgaaatgaggagagtactttcactatttgactgtacaaaatacttttgaagcatgcaaaaagaaaaaaaaaggataaaagacacgtaaaaccacaatagatattcggttatgagaatagtttgtttttagaacctaggttgcatttttctaaggtgaatagttttggaggatgcagtatttattcaatcaggaattgaagaattaaaaaatagcaactttacatagatttttaaaaatctagtttaaccaaattttatctttcaaatatgagaaattattttgcattactaataagaatatgtggcttttaaaaattatgacatgctttttttacattgatagcaacacaacaaaatactttgaagaaaggataacgatttaaaaatttattctcacagggagtttcattaagctgagcactggtatatatgtttttaattatttttatttttaggatttccatattgaagtatggtttgggtaaaatcttatcaaattattttgtttgtttactaagtactttgattgtataatgtctctagttcaaactgtaattctattttatattttctgtatttgtatttttaaaaaattctgttgattttttaatataaaaaacaaatgactgttatatttctagtcactcaaatttgaactgaattttacttcctgtttcaaaggtcaaggcaggctgacctcaacagcagtgtggaggctgctgaattattcatatcattgactttgtgtcagcttccacatttgtggagagggatgttttattcatttatctcatttagggttcttctctgcacctgtttctaccattaagtaccctgtaatttgcatttgatgctaatttagtttcatatcagcctggtccccccttgttaatttaattttctaagacccttttcattacagtagaactgttttcctctttaaagcaaacatctatacaagtaattgtataaactgccttttaaataatatcttttagaagattccatcgtttaattccttaattcctataattagccatggtttgattaatgtttcaaagggttaaattaaaatgcagaattactcaaatgcatactggaataatttcttatatacagcagagttagcgttgtggtgttcttcctgagaattctcagacagtatgtcttaacagcagtcattttctttatttagagtgctgtttagtttactaatagtgattctttcaaaatcactgtgcactcaacattactcgtgaaatgttagttttttttttttcatcaaattgttgatagacagtggcttaaaaatgtttctgcaacattgataatgacatacccaaaataatcagggcagaattaggtccaattccttgatctatcctggaagtttggtataatgaatttcaggaaactctgttatattatatgtctgtttctcttcttaccagctcttttatttctgtctgctgctcagggtagattgcctggaaatttgtcagctttccagacatggttttagccagctttggtttgtatctacggacacccgttgggctacagttgccacctacatattgtagaaattaggagtaagttgtttgaggaggcctgattgaaatggtggctacatggcagaagtggccatgtccctggaatgtctgtcaaggatttgggggttatgagaacatgctactcatataaaccaggtccatagcccctctgactgttcagaaaagaattctagctcagtccttttcttggaactgtttggagggtgtttgacatgaatggccttatggaatctgttggtagtgggaattcaaaacaagggtatgaattacgaattcaagcactaagatacgtgaaaattaaacagaagggaagtggctgcagctgaatattactaagaaattagcccaaactctacagatccttcttccactaggttggattagtttgatctgttgttcatattctctgggaaaaccaaatgaggcagttcctttgggtttccggaaagatctcaggtctattggaactggagtttgaaggtggcttttccttttctttcagttataaatgattcctggggactcccacacacaactttgtcattgtggaaatgtgaaagggtatctccagattttctagcagacagcttcatttgtctggttgcaaggtagggctgggggtggactggacaattccccagggtccccttcagctgagaacttccctggacctaccagtgactttttcacgtcctacagcttattaagctagctctgtgcttctgctgatggtcctaaagcaaagtgagagctttcaggaatgaaatacaggatctttattcattaacaaaacattttcttactcattctccctcctacatccccctcctccaggtttagatattctttttagtttggacaagtctgtaagctccaatagaaaagcctccttgaggtctgattaaacggctgggtttaaaaacaataaagactatctgcagagctcatgagaatgcaggaaaggttttcccacccaattctggctgatgcttggaattccactgtcagaatctcatccctttagctaagaaccttcaatgtataccaagacatacaaaacttagggaaggctagcactttaattctatcattcacatacctcttcgagggaatgacataaagatctcacatgggttcagctctttttagttttcatgacaacacagtgaggtaagcaggatttttttgtatcatttcacaaatatggagaatgaatagcttaagaacgctaatacatagcctagctagatcccaaaggcaggttttccaaaaaatctagattcctgtaggaagagaccacgattccatttaagctgagtggactctcagagattacagttcagccccttcattttaaagatgagaaagctgaggccaagagaagcacagcaatgttgcccaaagacctaattagtctcagagccaggaccataagccaagtccctggctctggttccagtggcttttctactactactctgggccatctgggtcctgctctgctctccatttcaccttgtgtgcaatcagccttagggaagggtacaacgtgtcttttctgggtttgggtccaaggaagcccctaagtcctgtatctctaacaaggcctagcattgtgcacggagcacaagttaaattgtttctcagaaattataacagtccgtcaggcgcggtggctcatgcttagtaatcccagcacttttggaggctgaggcaggtggatcacctgagattaggagttcgagaccagcctggccaaaatggcaaaacctcgtctctactaaaaatacaaaaatgagcttggtatgatggcacatgcctgtaatctcagctactcaggaggctgaggcaggagaatcacttgaacccaggaggcggaggttgcagtgagccaagatggtgccattgcacttcagcctgggtgacagagtgagactccatctcaaaaaaaaaaaaaaaaaaaagaaaagaaaagaaaagaaagaaattataacagtcacagggaggaggaagctacagaatatcccatcataaaatattactttatttttaaaagcccacatatttcatttatttgcaactgtgcttgttcatactatgtcatataacaccgtgcgacaaattgcaatttttgtttttgtttgccagaggtatttcatcaatagtcatctttcagtaggaattttacaaaaggtctttctattccagatgtcttaccatgagcagttgtctctgactattatctttctctggaaggtactgacatacataaatattgacgttggcaattttcaaagtaagtcttaataaaatttttcttttatttaaacctaaacaaattgaaagtaccctttccaaaaataataataaaggaagtgaggcattgttgcagaatataattctgaaaaaattgtagtgaaaggggaaaaaagtacactgtatttcttcctactcaaaccacttttgtgtacagttttgcctaagcccgaagaggtttgtcacacatttggaattgccaaggaagggcagaagtcatgggtatggtgctgagagaaattattagcccctggcatagtctcatgctgaactgcaggagaatgattccagaaggcaaaggggcattcattcgcctggtaagctagagggagaggtggggagttggcagcttctgtactgtttcagagtatggggcaaaggaggaagtgacaattatttcacctctgaattatttgactatctggtctggctgaaaagattgtgctgatttggaaaaatttaattttttccgtctccatagaaatatatgactgaatgtagtcaaccaactaaatctttcttcccagtatcaatccactaaaattaattttaaaaggtggaattttgaatttatgtatactcttttcttctctttttctcttcccaaattgtcataaatcattcaacaggctggattcctttctgctcccaaatagtttgataccagaagccagaaaggataatcatgctaaacctattaaaaaatggtttcatgtagggttagtctctcctttagaaaccattgtttacattcacagaggtggtgaggacaagcagctgttgagttcattgacctcagacaggagaaacaaaggacccagcatgttaatttattcaataaatgttcgtgaagcatctactatataaaataagttgtacccccaatcccagattggggactgccccagaagcactttgtggtcctcccagggcactcacctattaaggaaattggatttggtgtagaatctctttctcttttccaaatcaccaccaaatccattgccattcatctttctcctgccattacctggccattcccagggtaaggtcccacctccaaaaagagatttaaagtaattcactactcatcagatttagtgtaggttaattccctactatgctaataattttcatcttcaaggtactaatagttctaatatgaacccaaatttgtgcatattcttctgttaaggagaaagcatgctttggttctgttaaaggctcgacacattaaattgctcattctgatatgggacttctcattcattatgaaatgagaaggaacctcatgtagaatgctgaactgggacacaggagacctggttttgagtactgcccctgctgttatttagatatgtgagcctctgtgtctgtgtgtctcttaacttctctggatttcagctttcttatttatagaacgagagaagtaaacacttaggatctttaaggttacctctctcaatgactttaatcctctctacccttataaatctggttacctctcatatctgacattggacagtacctattattaaacatgtgcttaagtagcatgtactataaggtaaatagcaacctcacagaggtcagaactgaataaccaacaatattctcaatcaactttcagttcttcttccttacctcatccaagggatcagccaggtaataagaagataaggcagcaggtacagcccatgtctattgctaaaatctaccttaaggcaggaagctagtgggtgagatctttagatgatgcaccttacaaggctaattgagttgttatatttaaatttattggtagcataacttgggcaagatggggaagggatctagtaaaaagaaaattgtaggcttgtaaaatgtgaggcacgtggaccaacacatttgtctctgtgagatagtaaccccaaaaggttgtgggcagaggttgcctgtgcaacatcctcaagttgtctcttaatctggttgagacttgtcttccagatgaagcagcctaatgttgatatacagagaatctacactaagttgcacatagtacatgctcattaaataattgttcattttctgcatatccactttgtttctgtacttttagggtgtataattccttttaaggcaaataatgctgagcatctttggaatgaagctatgaaattatatgctctgctaatatcctttgcttgtgagtgacaatacagtatatattccttaagcttgaagaaattggaatttcataaaatcttgaaaaaaatttttttctatgtgcagaggagacgagagagagactgagaaacagaaaactttgtccaggatgggaaccagatctctctctctattttttaaattttaaattatccaaccgttaaatataaacattataatattttgacaggtttccaaagaaataaaattgtgagtcccatggataatgatttttctgagaattccaggtacagaataggccctttcaggatttcctgtttttttgtttgctttccttcgcttcttattttaggtccaataaaccttttactttaagcaggatcaagtgttaagacaaaccaactacagagctaatgtatagaacattaattctatagaaatgccctataaaaagcaaagaaataagactaactattaaaagaaatccatatgtctctggaatttttatttaagtttatattagcaataatgaccttggttctagggaattcggtaacgattaatgaccagcaaggggtcactggcctcatggtgctttgggccagcaaccccttccaaagaggacaagaactggccatttatcccaaggaagtgccctaaggcgaggtccttatcctcttgccatctgatggtaatttaacctcagcttttaaagggcccttaggagcaaatatacaatgggttgtgctttcagtattttaaagagtttatttttgccatgcaatgcctaattgggtatcattgaaaagagttgtcaaaataaagttggtaattatgttccttttattccggggtacatatactcattttgtgtctgcatatctgctggcttgtattggtgtagtgtgcatctatgcagatgcttatactcacattcccatgtctggggtgtgtgtgtgtgtgtgtgtgtgtgtgtgtgtgtgagagagagagagagagggagagaggggttaaaatacccaatgccagatcaacagaataaataaaacttgaatgatagaaacttcagtcacattagttttgcctgcaagaataaatccctgtaatatgtaaaataaggggccagaggcagagtaaaattagtcttttcttggttacagatgactggtgtggcagtgactggcattggcgttttgcatgttctatgtgttattgtcattactgtaattactgatgataactaaccatttatgaagccacatattagctgaattctgggtattctctcatttaatccttacagcaattctatgtgctgagtattcttatttctcccattttacagatgaggaaactggggcttcagttggttaaataacttgcccaacgtcaacatagctattaagtggtggagctgggatgccaaccttgcagtgtctgaccccaaagatcagggttttaatcataacactattctgcctctatttaaaaactaacatttccattttctaagcgcagcccttaatatattcatttaggcaaatttccatcctttgctggcgtaatcgctattccttttgttggtcattgctcccctgggcttccttcaaacatggtcagaggtgccccagactttttaaagatggaagaaaggccacatggccctgcataatttgaccgagacagctgtgcagttggttgtctcatttaaattacaaccacaaaaaagatgtgccaggcttcattgacacaaagctaagggcaggaacacggaaccgtttcctgaacctgccctgggttcctgccaaaggtaagcagccacgctcagcagggtctcacggaccactgaggaggcagtgagcttcactaaaacaattatccctccccagggctctgccgaaggtttgcagctccaaattctcatggtaaaggatccgtccagtctctgaattccagcttagaatggctgacctaggcaggacaattcctctgagagcgagggagaaaaaacaaaagtgtgggatttaaaaggctggtattgcaaaggatcatcttgacaggctgtggctcagatttagagaaaccccgaactgatttgcagaggactgaacaccaaaccttgtaaccacagagcagacttcggggaggtagtcataggacctgacaagcaatcttttaatacagaatctggtacaaagatccatgtgtgtatttttgctgtggttttttttttttttctatatcttttggaatggagtctaatcgtccaaaggatagttttcacgtgtagtgtttttctctttgatttgagataggaggttttctgtggctgctaagcaatacacatatacctacgtggcatacaatgtcttttttttttggtggaattcttagcatgcatatttttctcagctaaatgatttttaacagcagttatttagttcctattgcacctttccaaaattgcgttcatggtagatacttctcaaataaggtttagttttattaaaattcttacgtctttctgaaacaaatatactaaatcttccagaagagcccataataataataattttttttgcgtgtgtcttatgagcctgtgcgtatgtgtgcaccacgcagatttgtgtacacatttgtatgtaatactgttacaactataaatggcaaaagaacgtattttaagcctcttggggtttcaacaaattgtgataaaagggtggtggtggccgagatgactttctcccactctattaagaaaaagtgcaaaatgaatgagggcaaactgctggctgcgattgtgattgtgcacaactgcaaagcgggatcggctgggatggaggccacggagcaggaacaccccgtgtcttgcccccccttctgaatgcctctcagtagtggcattgtggggactcatgaattacttcttacagtcggggctccttgctataaatccagccctggtgccgagcgcactgtgggcagcggagcaccgagccgggccggcggtgtttgtgttgttgttagcgacacgtagcgagttcctcctaagcggaaaggccccggctccagtttgtcgccagcgaaagccgaaacacgagtcgcacatgtggagcgggagccgtcagccgccgggcggcggggtgggggggtgggggggctgcgggagccggggggagggggagggnnnnnnnnnnnnnnnnnnnnnnnnnnnnnnnnnnnnnnnnnnnnnngggggagggaatgcggcccgaggcggggcctagcgctcaccgggggatttgtttggggggctggggaggggagagaggggacagggtgggagcaaagaaagtagcccaaggggaaccaggaaaaggatgccttgacctctaaatgttgtgccctccccgtgacatctcactacttgtgagaatatttgagaattaaaataaaaaaaaaaggaaccctttgtggtgcggcttcaaaatggttttccttcccaggatatcctgtgcctgtctttgggtgagtttttcataggttacttggttaggagacttctcctatccctttaagaggtaaaaacataaaaaacaaatgtaaatgtagggactttaacacttccccccttcctaacattcgtataattgctgttaagccacactgaaaaccctggggcctggtgttcaccagggtaaagttacatttcacaagcagaaaattgactcaccacttaggaaaattggctaccaattatgtgtcaaaggctctaaagtcagacctgaggttttctttttgccagaatggggaattaaaaagagcacaggcacccagctttgtacccactactccctccgggagcaattcttgcttgccgctgggtttcttctgagtttgcttctaagccttggcggggaaggagggctcctggctgaacccagccagactggctagcaggatgaacggaggcaggagtcagtcaacccttataagtgagttcatgcacaagtatgttacaaacatgcttatggcctgtgtgcagaaagtaactggtggcctagcacagttgaccaaagttctgagagctatgactgagactcaggggcccaggggagctggagaaaggaggggcttctgaaggccaagtcactaaagtcaagggacatctgctgtctctggtgacatgtttatcacacccacaccacgtacattgtcctggaaatttattgttgtctcctcttgtaggagaagccacctgggcaggaggggagacagtcccttgtgggaggactgatggtcctggtggggaagcatggaggggtagaagtcaagagagaacaagaggaagagacagacagggatacagagtcatagatacaggggcagaggaagagcaatgcagagagggagagggaggagaggagagagagagggaggagaggagagagagagggaggagaggagagagagagaaaagagagaagagagagagagagagagagagagagagaaagagaaacgaacctcttgtttacttctctccccgctgtcccctggttctcctgtatccactttcttgacatactccttgccttcttccaaggcctgctttctgttcctgtcagagtggcttatccttggttttgtttttaatgccgtgaaattaaaccttatttagtgcttcattttctgcctctagagggagagaaagagaaagcgttaggacccaccaaattgaatgaatttgctgtgctgtgtcggagagagttagttttgtaggacaaccgggatgtaaaatcattctggagattatcaccagataagcacccctcccaagaacacgatgtgatatgtaataattttagtgaggaaaaccatccttgttttgccttctgggaaatcttatgctatttctatttgattctaacgttggacaatttccagagttctgaagaaccaactatcttaactcctcaatgattttgacagggaagacaaaaaagggacagcaattctggggctggggctggatctcaaccaaaatatctaatttcaatttagtcctggcttcttagctggaacaaagagaaagtttttacattttgcagaatatttagttcgcctcaaagtctattgggttaaaatatatgtgtgtgtgagtttttcctttcatagtggttcagaatgcctgagagtttgtctaatcaagactcaaacattttgagtggattttttttccctccaccatcctacttctctgagatatcttttctagttttaagaatctcacaagctccctcaagtgatgcttaattagaggagctttctatccactaagtattttcttaaatgtataattgattgtgcaaggaaggaagagctgctggagtggaaatcatacatcatttcattattaatggcaatgtctaagtaaaatgcagacattgtcatgctaatggatagctgtgtatgtttagctttaaatcagaagcttttttcccctttactgttctgggatcattttaggaagtttaagtagcatttaatatattgataaatacctgctagcatgctgggctaaggttggaaaaaggagccaaatgaaatcctgacgaatgcaggggaatggtgtgacaaaatgaataatttgggatgccatgtacattattacctcctttttactacctgtgaagaagctggatttttacctggatttaatttggaagacatgtgtatttagcacttactgtgtactgcttccactgaaaacatccacagatgtcctcagagaacaacagaactgaaaagttgctgaacggccctcaccctgtttttggtgtggaattcatcagccagagtgaaagagtctcttgtggatcctgaaatggctggcttagatcagaggctttcttagtttgcagttccccagaaattagaccttcagcagggatttggatgcaggtagtttatatgggcatgatcttaggaagcaggaaatgagggagagagaagagggaaaaaaggcaaggaagaaaaagtaaggcagtgatgtattatcagagtcactgctgtggctggtacatggtcccattggaatcttctaagggacagagtaaaatgtgcctcctagagccaggctccagaagtacaagaggctagagcattatctcctggcacctgtcccctcttggttgagggctgtcccagggtgctggtgtgcaggctgggcatctgcttcagagttggcatgccgtggaaggaagccacgacatagcaggttgtggtcagggtcagacatgtggctgaagtcagaggtgggacacagggatgtgaggtaggcaccagatgcatctgttatagaagctgagtgtaaagttcctatggggagggaagcttgatagtccatccttttttctttattgagtacctactgcgtacttgggtgtaggaggcatctggtgattcttcattgagtccatcaagaagtgcacaaattcatataccacaaatgtttgttgagtgctcattgtatgtctggagaccattctgtcttcttccctaagagtgttcatgctgttggaccaggtgttatgattttgctctggagaataaggtatttccacatggagcatgtggaaaatatagtgcctatctcctgaaaggtccaggtgatgcaaagatgaatgagacatgattggaggtttttcttctgtctgaaatgcagacagttctgggttgggcagctctgtaagatgctgaacatgtgtccttccaagaagcaaggatcagaaagcagactttgatgggggatgtgagagaaaaagttcagacaggcttctatgaatttactaaaagttttggaaaggttatacccccgtgggagggaaatagcagtaatggggtatgtggcaatgggtacaaaagggttggggctgatgtgtgaaggaccttgaagggcatgagaagaggtatgggttttcttttgtagggagtctttttacacaaaggggaacataaaattcatgtggatgaaaactcaatgtcaaaacatgaattcatcttcctccttattattgatggatttctctgtcccttcagttataggaaccgaggagtcatccttgctgttgcccctcccccatctctgtcagccatactagttatctctcagctctgtcccctttgcgccaccccaactctgccacctgactcctgccttaactccagattggtgtctctgcaatcttttggtttctctagagacccttctctccttataggagccaaagtaagcttttgagaattcgaagctgatcacgacattctgtagcctttaactcatcagtggctccttattgttcttaggataaaagccaactttcttactcatctgctgttcccattgcttctgtcacggacattccttcctctctgagaagctcaattcatccgtcagattctagcccctttcccttcagttctcagagacaccttcactccccagctgggtcagttcccagcataggatgctctaagccccatgcagccaggagctgtggttgtttgtttactattctattcctcctgacactcagtactcaataataaacacagtgccagacactcggtacgcagtaatatctattgaatgagttattggatgaaaagcaatgtagcttgtggctgtggagggtacggattctgtccagtgttgtgctgtagctggcttatgtggactcatgagaaccaactgagtgaatcttttcccagctctgttcagtgatatcacattggtagcttgaagtcattcatagtggggatatttacaccatagaaattggcaaacactacagagccgggctccctccacccactttactcagaacactgttgatcctgccagtcatgaatcttatccaatcttaggtttctcagatttacccctccatactatgtctttgtcaccagttttctggagggcagagatcacatcttattagtctctgaatcattaatctgtagcagagtgtacaactcaataagcacctgtttaaaaaaagaaagacgctcactagtagcttgagtctccagtcctggcatgctgtctcttctacttaatgtgctctttgagaaaaggattttgaaatgatgctttggcctatttgaggtctcttcccttccaccactccacttaggcccatggctcttacacattccgcttatgttacagtagaatgttttaataagtaggatttttgtcattgcacaagtcgacacaattatgggaatagctaaaattcaccagtagacctagtgggttcaattcaacaagattattgagagcctgttttgtgggagatgctattgctcatatgctagtgaaacagacattttctaccctcgagggtctgtgcactgagaggcatagtcatatgcaaaccaagagtaactgataagatggttaaatggtgggacagagtgtcaggggcacctgtatcggaattgattaattctgtgtgggggtcatggaaagctagagagaagggatatttgagttagacttggaggaatatacggagagctgtagggaacagttcccagaggcaaggagatcaatttgggaagttactgggatagtaatggcccagagataatgaagtcttggtcattactggtggcagagctagaaggcagtgggcagggaacaaagctcagataggctatggggagctgagggagaagagaatcaaggtgaactgtctggatcattttctcctccagtcctttttgtggtgggaagatgggagaattggaatgatctaaatatggcttcctaatgttcatgttatcttgactaatcttgataagactttatgacaactttatctcaagctcctgcagtttcaatagaaattggattttaggatgcacaatttgatttagccaaacagctttggacttccatcctacttcattgtccctgagtgtcatgactgtcattgtctgcattctaattctgtttctatttgaatcattcattaagtacctaaaaattatgcatatagtaaattcacaggataccatatgcaaataggaagcacccctcaccctggtcctaaataaacattgtggatttgttaagtaaatttgggagtttcagatcttttttttaatgcaatgaattgtaatgtcacacttccaatacgacaaggattctttttttttcttcttcttcttttaaatacaaggggaaaaaaaaattcattttgagtcagaaagtgggtgtacgtaggggagaaaaaaggagggagggaggaactgtgtataacttctcttctgcgttttggcacaaaaaagttgctcccatcagctcagcttggctaagagaggcctccagataagaattcttgagatctctgattcttctccacatgaaaatttaaaaaacattaaaaaaagaagaaattacaaatgatctgatcttgaatgccaaaaatctaacctttgatgttggcttttcggaagttaaataatgaaccaaagtttctttttttccttttttcttaaaggactacttcataaagcctatcttactttataataaaaggaggaaaacataaataaaagacactcaaatatttatacagttattcaaaggattaaatgtatttggtaaggtcttaaggttgtttaatattttccccttcttttgaatctttgtttttagctctggtacattgaagattttctttttcctgtggttttgtttatagaaattaacaaattcccttgtgatccttaagaagttactttagaaatatacaaatatacatgaatgagagaaaggggatatgaaatagatgagataaggaaatattgtcataataactacactctttatattacactacttagttaacactacgtataattgaataaatgacaacaacagtgagtaatagactacttatttgactcagagagaaaaatcttggggacctgcactttagaagaatataattttacttttaatttttatgttatatgaatactctgtggcaatgtacatactccacatgtattttctgcctcgtgacttacactggaagagagaggaatgattagtttatatgttaaaaatgcagtgaatttttatttgtcctgagtccacttcctccactcctacacaccagctaggattctcttgtgagacagaacacactttatagttttggtttgtttaattatatgaaaatttaagtattcagacaatagtttttagtagattaaaagaacaacaatagcgacaacccccacaacacctgcattaacttggggtccttcaaaagcccagtgtttccaataatgtaatttgttgcttaataaataggaggttgggcccaatatcctctgctaagattgtcatcacttacacttaagatgaattaaatttctcttaacaaacattagtgggtattctatgtagttaaacattctggttaatagataatttcttcatatgatatacacagaacatcatttttagatataataacatagctatgatcaatacagttttattcaacaattaggtgttgtataaggtccctgggggaattgtataaagtgttcccatctctcaaagaacttctcacctagtgacatttttctgtgattcagagataccttggtgacttgctgtgaattagggtcacaattatgactatcatttatcattgtactgtgactgcacaagtgccagttaatagaagattcagaatgatagaatgcagaataaatcacatcacctttttctggagtagtgtcttggtgagccgaagcagaagcagagaatggatactgatattatttccatctgcaagccctcatgacgtatgaagtgccgagagacatttatggttttgttgctaccattaagacctttggcagagtcctaaacttattttggtctctctctcttttattgcaagctatttccagctgtttatttttatcttgctttgagatgtttaaataaaagacataatttgaatctaaattgtggttgttatcagatctggctagaataataagacagtgataccaattctcctggcttgaagtttggagtagtgggtcatttattcattcagtggacacctactatgtaccaagcgaagactgttgtagactttgcatagactttacagtctagtgggagagacagtcattcaaagaatcacataaataaaggtaaaattacaattgttttaggtgctatgaaggaaagggcaggaggatgatatgatatgccagggagaagaactggcttattgagggttctggaaatgtgtcctcagtgaagtgatgatcaaactgagcaaatctcttatgcctgcattttccccttagagtccaaacatacatgctggagtcagatggacaagggttccaagcctccaatgttcctaactagccataagaccttggaaaagtaacctcatctctttggaacttggagtttttgtctgcaaaatagagaaagcaacatccatcctgctggattgcttggtgttgttgaaacaatacattctataggtacctgattcaattagacagtaggtgcttcataaatatcagctactattattatttcacctatgataaaatataagttatgtgaatcaggccttatcctttccagagatattttttaagagggctttcctgaagcctaaccttaagcagctacctagtagctccctgtcatgacatcctatttaacttttttatttttttttttttactgtgaatgtttggtaaataaaaataaaatatatgtaacacatgctataaagtcatccaaacttgtgaacactctacagaacttaacaacttagactttttaaaatttaagatattaataagtaggagggctatggtacacttgtctttagaagacggattatgtgtaagactctgagcctggaagccattatagacagccctaaaatactttttgtgtaggctaatcgaaacatacagacgcacgtgcacacacgcgcacacacgcacacaggcaaagaattttttttttcctttgggaaaacagtaatatgtgtaaactggtttggaggaagtttattgtttcccagccagaatgacatttaggatatttgaattcattgatcatagttttaggtaaataaacactgaaatagggtcagcttttagatatatggatgggctgggatgcaagagaaaggctggcttcgggtccaggctttgcctttgatgggctatgtacctgggacttgtttattttgctttttttggagcttcagtttcctcacctctgaattgagtggatgaaaggaccgtcaaggtttgccacgtcctcattccctgcttctgtgatctgatcttctcagatccagatccctttgtgagcagaagatgcaggcagggaccaggatccccatgaatgaggtaggctacctgcaggtgtgcatccctccatgccatggctttgatgggttggcgccgacagcaagcttttttgcatgggaaaaagttcccttccaattacacagcagttttgtggtggctgaggggctataatgggaatgctttgcagccaaagcactctcattcataaattccactgtgacactctctctaatttttttctcttttggatagatcagtattctgtggtttcctccaccacagccatgcaagcaaaagtgagtagttaaatctcgtcatggcctttaagtctctgcaacacacggacatgacagtgtcaatcataagcaatatttggtgcagtaaataacagtgagctgacccttccaatatcttctaggaggcgtctttaaaatgaagtacaggaaggaactaaatataggagctggtctgtttctagtttatggatttctctagaaatagacattttattctggtaaaagctctgtgttcatcacacacagctagatgcatgtgctgaatgtcaacctctgtgcaggtgtgaatatctaatgtaaattatggaaatttaggctgcttttaaaaaatattttctacatctgcttttgtaatttgcattattcctgggatccctttctagaagtgactaaaatgcagaaagaaaatcaaagtaaatgtcattcaaagaaatgaaatacataaaataaccacacagaatccatacgcgacaggctgttttagtatttatttttttaaacgtaagaagtatatatattcccttaaagccaatgtatgagtccctttagcagtgatctaaaagatttctacttcatgaaaaacctattcctctgagaatctgcaccctgtgttcaggtaggtatgtatatgacacagaacattaaaaagttaacgtttgccttttccatgcagtgtttgctatgttttcatagcagggatgagttagattcagcataattggaatttcagaaatactgttagtttattaaggcattggggattggtcaagctcagttcaaatgaccattgatgtgtgtgacgatgggtaccaaattgtggtgtactgaactgtggattgtaagtctgccaagggtttgcctctgtatttctctttggaaaagatgactgttcctctgtagatatgtagcacagaatccgtttctaaacagctactataaaatctgtttattggtgtctcttgtctacatacagccacctgtctaaaagcataaattcacatgtagagagtggtctattctccctacatgagtatatgtcacccccatcggcatcagtgaaagctatgtgcttaccagcaggagaatagattcatatgctgtgaaaaggtatggaattctgatttatagtctgtgttgcttttaatggatatacctgcaacagccacagagctaaacctgtaaggtgttaaaataaaacattttacagtgcaatatattgcctgcttgttagttaaaagcactaccagggagcacactttggttaaatttggctgtgttaaaaacatatgtaaaaaaatctttgttttcttttctccattcttgttctctgtatttctccaaggatgctttccctgtttccaggactcaaggcctggcaacaccaagggcactgagggtggacatgagtgtggcttcagacgaaactaaaatgaaagattaaagcaattctgaaagatttcaagataggccactgccaactcagcttcagaagaagaaaaagggaaggaaaactagtttcttgagttgcttgtaatctggatcatagccattttggtggtggcctcaatggatgtaaagtagatagtgctttcaaacccttcatgccaaggctcaaaagcctttgcagaatcatttattaaatatttaagcgcttcctctttctgcctctcactcagcgacagagagagcctgagagcagcattttctaagcccagtgtggtgctggtgtgcggcactttccttaggtttactggccagggtcagctttgttttggctgatgctcaagcaagcacccctcactcacagctgcaggaccctcaccactacagttacaaatggatctacgtccttttgtgtttgtggagtctttaagtgaggtggcattttaaagaaattcacagtgctttagagaatggttaatattacatttgagcaaaaaacaattttacgcataaaatttaggattacctcaagcaaagcttttgtttagttttgtcaccttttagaggtactccagaaaatattttaaacctagctgtgtatatcaagggtctggggacctcattattagaaatggtggtctgtactcattcgatattttattccttacttgttttactccctgcccaagtcttgcttttaggtgagcatgaatcaaatccaatgggacatttttagctcttcccagggcccttgagaaggaataatagtatgtgttggttttaagtttcatgacaaaaccgcttttaatatttaaataatttttcttctgaaatggggaactccaaataaaaaagttatttaatagcgaagttactttaacaactggctttcctatttctttctttcttaaaatctggaatggtgctaaaataaagtataatgtaatatttcagataaatatatttaggccctgtgaaaatcctgcttcacagcatttgtagggaaatgtaacgcatgcaaaagtagacagtagtttatatagtagttttattttaactagtacaatataacaacctgacatgctgtgaaaaataaataacttttagaaaatgcattttccaagtatgaaagtaatgttgaaaaatgactgaggtaatcacttttgtatagattctgaaagtagaagagaggggaataataatttatggtttaatgcatagagttatacaaaagtgtaaaagattttcttttctgacggacccagaggaatctgctgtgccattttgcagaatgactcagggaagagggctgacttgtgagccagcacgtgcaggcatcttggccaactcatttataccacagactctttgttttggttttggggttagcagattgagtaaatggatttcttttttattccttcagaggaaaaaggactcttttggctgttaaattccaattttctaaaggaagtaaacattccatctcaggcttctcacacatcagataaacaccactttgaatcatatgtttatcctggaaggaaatcgcctctccattttgtagatgggggcccaggaaagaggctacttgtccgagatcctacagctagtgggcatctgaaccaggatctctttctaccccatcccattagccctcctgggaagagttagggtggaatttctgagacttccacagcaattaggtgctcagacactagatcaaggggaactttcaaagtgttgttgatagtcttgctaataggtcaggcagcccaaaacagcgcaaatattatgaggtgatcagcactacaccaaggaatggcttaggaatgaggtctgatccccactctccatagtctctatcagctacccactggccttcttaaatgcagtctaagttaatgtgtgtttgcttgctgtgaggcatggcctctttgctaatttctttcacccccatactctcctcctgtatggaaatactagtgccaccctgcatttgattttttttaagttgttttgaccgtgagtcttaatgtctccctttgatatgagtaggtaggtccatctcgactggagaatgtatacataaaaagtctctttcattggttctaaaagtgtaaaatatctgggctgttacctaaatgcagaatggagaaggcagggcaaggtcagagtagggtgggtttcccccctcatttccctccactgtttcccatggtgtttcatctttttgccataaagcttataggttaaagagaaaggtgagattgctttgctgtctgtcatggtgatggtgggccgtgagtttagggagaaaggactgccgagataagaaatgaaatggtcttgaatctctgggattgcaaaggacaaggaaagatatggggcaaaatcaagacatttccttcacagtatcccagagaagtgtggtgagttcttcaaaaatagccttggcagccagcctctcttgccactctggcactgcacacgaacctaggtatgggtatttgtgcagaaacagtccctgcaaattgacttgaaccccagtcctctttccctaggagatcagaggatggctgatgtggcaaatgtgatggtggcagtggtccttattgataaggaagcttggaggggttgagagaggagctgatcttcttttttttattattatactttaagttttagagtacatgtgcacattgtgcaggttagttacatatgtatacatgtgccatgctggtgtgctgcacccactaactcgtcatctagcattaggtatatctcccaatgctatccctcccccctccccccaccccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatggctagccgttttcccagcaccatttattaaatagggaatcctttccccatttcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatacctccagctttgttcttttggcttaggattgacttggcgatgtgggctcttttttggttccatatgaactttaaagtagttttttccaattctgtgaaggaagtccttggtagcttgatggggatggcattgaatctgtaaatgaggagctgatcttcttatcagaagcaaggtatctaaaagtgccaacccatccctgatgcgacaattgagcagttgaagtgcaactctgaaattcttctcttctgatctctcaatcactgtcttcagtcttttatcctgcatcacaaactttatcccttactctgcacccatgaagccaatattccctaagaaccaagtctctcctgagaaaggcaaggtgatatgaatagagtgaaatagtttcatgtcccccaccactgggggtcaggaaaggagaacttcccttttaaatctttggggagatcaacccaaggactgaatcttttaatggtaaagttcaaggtccttcgaaccccaaaaggagattttaagggagtgagtgattatcacaatacttttgtgcatgcatgaccctgggaagggcaataatttggaaggcaaattctgtttcctcacattcttcagcctctccattcataaaacaagtctgaaaagtgatttcttgcctacccatataaaataatttgggatctgataaaaatgataatgtcagtcaacattgcttatgtgacaacagctgttgtcatccttatgtataggtgaggaaagctgaagcttagcgaggttggatgaattgtacaaagtctacagctagtttgtagaaaaactgggatttgaatccaggtagtttaatttcagcctctaagtatgaaaccatcactctgtactgcctccttcaaatatggtccaagatccttcaatcctgtgatttataacgtcaaatttctgctgataacttaacctttggtatcatttaacatctagagctgccaaatagattttctgactttaaaactcttggtttcttcctggcatttacttttcacttattttggtgtttttttaatttattatttattttttattttttaccaatgttccatttagcagaagtaaaacagaaaatttttggtgatttagagatgtttcccttcttgtaagctttcagtcactgatggctgatgagcctttggatttattgctcccctgatgaaatggtggtctaaactcagctgccttggttctcgttctctctctctctctctttctttctctttctttccccctgtttctgatggcttcaatcagtcaataatgtaattaggccacaaaaatagagaaaaccagtggcttctggtttattttttgattttctagtaggaaatacccctaatccttgatgttctcttgcatatattttccaaagagcaccatgtgaagccagatttttattgactggtctttgtttctcaacatgaggggaaaaatggggatagggcattgtcctggttggacaaggtaggcaggaagcatcaggcagcaggatcttgtgccttgctcttggtttttattacctggagctccatcatgagtctcagggtggattgaaatcttgcattgaggccaaaagtgaaaggaaaaccaggacaaagaaatctgcagggcaaggggtggggcttggttagcaagagcaatggaaaacaacgacaatgaagtagcttgtagcttgctgcctaatgtgtgtaaagcgatggtacaggcaagatggagttaattcaataaaataaatataaaatactctctcctctgtcaggcctcgctggaagcaggtcaggggtcactgagccgcttcactggagcactaatcgatttgctgtcaaggtggcctgctggggtttcaagccagagaggaattgagaggcgctctggcccaatttccataattgctcactgcctttagtgtacaaccttttatgaaacacaaaaaatatatcatggaattgtattgattagccattgggctgaataattcacttagtatttattacctgaccccaagaggttaaataaatccactatctaacttgggtttgtgagaaatattacttattcattgaaatgtgggctgtttattgcacaataggcctgtatctttgtttcttgattttgcaatcaagattaacccttcttgcattttagggccaacaagtcaaaaaaagcatagtttgagtgctccccaaaataagcccaataaaatcaatgctgaatatccctttgaagcagtttttttgatgttgaattttagtcctttgagtcaaatttcaagatggcctcaatgtatggatgccaatgaaatatagatgcaagcctggttttcactgcaaacactacatattataataacagatgtaataatagtgatgacatctaagcccatttttattacaccatttttggaaagcttaccctattacattaaacacccataaattagatgtcccaggagacaaaggggtgtaggaggtcgttgggtagaatgaagacttttttggtcttaaagaggaatcaatcctggacagataactgatatttattccagaaaaaaagctaattttcagtaacttgaaaatatgatggaattttatctgtagggcattttatgcatttgtaaactttggggcaatcattaattatttaccagccaatggcatttgcacatttctgttactctgagcagtaaatctgttttgatgtgctatgcatcccaggcacaactacatgacattcaaatctaattatgttctcagttgccatgagctctcactgtcaagatacaacccttccttaactccctccgaaaaagacgttttaacttttgtgtaaagtctttcttcagtttcctgtctgcatcctctagcatctcaaagcattgtttttgaggtttaatggaatttgttgtaggtcaaggaaaggaagccatgtgaagctttttttcccctctcttcaatgaaagggaaaggaaaaaaacattcatttgagttcagagctaactatgtttgttgatcatttagcatttctgtatccaggatctaatcttacgattaatggtaggaaaagctggggctctggagttatgctcagaatctgcctttcctgtgctgcggagtggaaggaagggatggctgcaaagcgggtaaacgtgtgcagaacttcctaaagcatgctcaggtgcaccccacttcccgcttccaggcggctgctcctgtgaatttgggcattacatttaatttctgtgttccatgttaccatgatttgttgattatcattttggaaattttcaagtttgggttttggtgtttggtctctatatttagtttgggggtgggggcggatgtgggagggtggagaaggtagaggagggaaagagagacagaatagaatacttgattttttttttaagcaaggttttaagtcttgctttccttcccctcccttctctctgtgtggggctcctttaaatagagaacatagttaacaaaatgacttgagagctcttgatagcctcttgagataatttggttgtaagcactgagcaaaatacattctttggatatactcatttcaagtgctaatcatgaatgttaaatttttaaggaagccaatgtcataatactgttcatggcaattccaaaataaatattagtgagatgctttgaagggagagggtggtttcggagagatagggagacagacagactctggtttatgtttccatagaattcttctataatgtaacccggaatctgccataaggcacaggatttgcctatgtttaagaataacaatgtatagaaaagagatctgttgaagaggctagaaataatcactcggttttatgcagctttatgtaatagtccaaggaaactaagagctgatcgaggagccagtggcgtgtcttgatttctaaatataaccattttgaatgggtgagggaaatcccttcctatgcaataaatataatggaaagggcctagtctttgaaatcagatggccctgggtttgaatcctggctaccacttgtacctggaaaaattaagtaaattattctgttttttacatttgtacaacggagataatcatacctatactcacaggattttggactgaggatttaggaatcaggattacaggagatgattccggcacaaattaatgtataaataagtggtagttgttctattgttattcttcagaaaattaaacagggcatttgttacacctgttgatattgactggacattttgagactcttcttggtggagatgctaaactgaaaacaacctacacataccagagcatccaagaatgtattcaccaggtaacctagaagaaatacatagttcaacatttgaaaatttttttttatcattaaaattccttcgaagacgggaggagtgtggctgatttgcaactgcacccacaaaagatggcgggttttgttttatattttaactaaaagtggtgaagattttccaactgttctatttttacaaattttaaaagtttcattgctgggttagatttagggcctgtgtgggaaacagagacttctgccagcagcgcagcgagagccctgctgtgttgtggtttccatgtatttttacattccacgcattgctgaactgtgtataggagcaagctctaaatcaccggtgctttatgtgagtttgcgacctttcgatttgggcttcagactgaatgcatgattttaaaactggagatgtgctagtgactgtgccacagactttgcctcctccccttctcccagctccatccttcacttccccagttgaagtcaaatgtagactttatatagcacaggaaacatttgggactgctagtaaatacgtgtaagaaaggaggaggctttcgttgttggaggtgcatatgcatatgctgggcattaaagaaagcctggtggagatgggaggtgaggagggggttactgcttcccccaaatgtccagattttttcaggacagattatctgtcttagtggattctggacatgttgttaaagaattccacatacaggatccctttctagttggtgatcctcttttataaattccgacagctccaaatgttgtttaggcccctgacctcttctccacatcccagcctgtccctgggctgtactcttttcttttcttttctttttttttgagacgaagtctcgctctgtagcccaggttggagtacagtggcatgatctcagctcaccacaacctccgcctcgcgggttcaagcgattctcctgcctcagcctccagagtagctgggattacaggcacacaccactgcatctggctaactttttgtatttttagtagatatggggtttcaccatattggccaggctggtcttgaactcccaacctcaggtaatccgcctgcctcgagctccgaaagtgctgggattataggcatgaaccaccatgcccggctactgttttcatacttcacggccccacaaccagcccatcatgcacactacagccatgctactctccataaagtcctgttctgaacatgtcactgtggctcacattcattggaaccctcttgctttgacttatttggcctgtgggcttaaattcaccttttcagccttatattcctttaatgtgctcaggagtgtccatgcttctgcgacccagacttctttctctttcccagacacattcagtacttgctcatcgccaatttcttgctccccttgctccttctgcagggctgcctttcccacctggccctccgctcagatcggatcctgttgtccctgtaaggatccacacaaaggctcgcctctgcaggaggttttctccagctcctctggagggaatctgtcctgcctctctctagtgcttcattcatgatcagattttaattaaaagtatatctatttactcaacaaatatttgtggagtatttcttttatgccagctcctttgcttatgctgggatgtagagatgaataataatataccatcccctggccatcaagggttatttttaaacattaaaaaaaggttagaaaagtaatttaattgcattacagaaaaattggaaaagacataaaaaaggaaagaccccataatccaattataatcatcttattgcacttttaattcatgtgcacttctacattttaaaaaaattatgatattgcaactacaattttgtgttctttgttttacattcatatatatatatgtaaaacaaagtatatatatatttttttctgtgtctctacatagcctaggtttaatggataataaattaccttcttattgttgaaaattgaggttttttcattttcaactattatttacaaataatactgatgaacatattcatatttatagttttttttttttttagaaggagttttgctctttgttgcccaggctggagtgcaatggtgtgatcttggctcactgcaacctctgcctcccagattcaagtgatgatactctcgcctcagcctcctgagtagctgggactacaggcacacactaccatacccagctaatttttgtatttttagtagagaaggggtttcacatgttggccaggctggtctcgaattcctgacctcaagtgatccacccgccttgggcttccaaagtgttaggattacaggcatgagccatggtgcccggcctagttattttttataatttggatcatttctttaagatagtagggtgatttttaaaaaattattagaacttctttttcaagtaaacttgaaacagaatctgaatttctacaacagaactgtgctggttgtcaggaggtagaatccctatagccccacgcattcttcccctttcataatcattccctggactttgctgtcagaaatcttgaagcccctctgcaggatcctagggctttgcagaaaatactttgaaagccttgggataaatctcagaagaattactccttcagacacttcaacattttcatggctctcaatgcataatgtcaaattgttttccaacaacttgagtctccagtgctcgattctattggttatttgtgagaataccacttattcaaatctttgccaacatcgtgtatctatcattaaatttacttttacctaacttaatagattcaaattgggctttacttacatgagtatttctcttatgagtatggttgggcattttcccatatgtgcatattttatttatatgtcttttttggtgacttctctatttcattcccattgattcattctttatggagatcttattttgcttatcaattggtttaaggctttatagaataaagataatagctatcaaaaataatatatatactttagggttgtgaaacacgtatgattgattcttccattttgtttgcaaagcaaacaactgtgattttattcccagtacccactctgccacactccagcctcactggccttcttctgaaatgccaaacctgttcatcccttgggaacttgctgttccttctttcaagaacttttcctgcagaataaccatgactggctctttcttgtcttttagctcaaatatcacctcagagaagctcctcctttccttccaaccttccatccaaccatcaagccacccagtcatccagtcctccatttatcctttaacaaatgtttgttgaatccatgctccgtgctagcactgtgcttggtgcaggggatacagctgtgaacaaaacagatgaagtctctctgttttcatgttgaatatcttactcttatttgtttctttctttaattgtgtgactccttcacccccacccgtagaatggcaattctgtgtgaacgggtaccttatccttcttgctcaccattacattccagcccaatactttctaaataaatatttgctgaatgaaaaatatttctaagcccaccccttctgcaatctcctcctctagtacggtaccattacaattgcttggtatgttgatagcatcttttcagaagcttagattttcttagtccagcagtatatttattgggtttactctctcttccttgtcaccaagttcctggatagaatgaaatgagggaatatcctctctcctctatccttaccccaagtcctcctattgccatgatgccactcatgaggtttgatccaaaggatgtatttttcctttagtgcatgagcccagttcccattagggttaatgaggaggatgctctttcatctagagcctgctgggattgttcaagcaccgtctacatacttaaaatagagacacttcagaaagtaggaagcagttgcacaaagccccaacttcaacctgcttttaataatagaaactcttatttaccaagtccgtgtcattttttcccttgcaagctttatttggaagataaatgggctaaagttcatttttccagaagagagtaaatgaaagatccatatgagctgggggaaccctgggtgtgacaaacttgcatgtactttgtacaactcaggagctgcaaagatctactcaaaattcagctgtggcctaccctgctgagtgacagttgttggaaggctggaaaattccggctagaggggtaggaaccagaatcagcatgtccttgtttcaatccagtaagtgtttttcagatgccagctgctacacagtgctgagaagtcaggcggtgactatgataaagaactaacgttttgggatagtgtgatctgaagatcaactggtcaaatgaagattcccaagcctcagccagaattagaatatctagggtcaggtgactaggaatttgcattttcagcaagctcctcttagattcttttgcattctaaggtctgaagaacactggtgtggtagtgtgagaaagaaagacagaaaataatgattgagtgctgaatgttaagcaaagtgctaggagagggtatgttagggcagcctaacctggtctggggatgaacagtggtctgagaaggctcctggaagaagcgacattgtattagtaacttggaggagtaagggttagctaggaggggatggggttgaggcctggtcttggataaatgatagattaataggaggaggaatttagtagctctctgaaaagtgttcaagtcatcagtgtgaactagcacaatgtccatgtgtctacaacatcaggaatgggaggagtgtacaggtaggaatttcttgctcatgaaaaaaatcaggctacatagtggcactgcccctgctgaaatgctggacataccctcttcctgttttctaatggagggacgaatggatccaggacagccatgaaaatatgcactaatggtccagatagatgcctgaggccagaaaagccaactgggtggggctaatggaaattaggcagggcccaaactaaatgaaatagattgtatctcctcttctcttcatttttcagtttgtttgattccccccaagtgggaatttgtttgtgctgcaggcagaggcctacttttttctcttagcttagagacacagggagggcaaggagcagaaaaaggaaggtttgattattagaaaataaagcgacattggtcctctgcttgtgtactgggccatgtccttcccagatcaactatctgctgatctgatgtagtagatttcgatgtctagggctgcatttagcttagggaaataaaaatttgatttgagaacatgcatgccttctaaggcctgtagttctggagaaatgtgagtccagcatgtggggtggatttttttctgtgctggggaataaaggcctggacttcgttgggatggtaagagcaatggtggccagcctaggactctgttggtgtcagttctagttttcccagcattgctaatgggaaatgttatttctgcccccacagttcttaactcctatgtttgcttggtttgttagcactgactggcttccctctgtatgctcttccttctcctgtagtcttaaatgttcttacactgacctggctatttaaaagcatgaatttcctgatttgaggctatttgtatttaacctggaatttttcttccctaagtccaacttatattaaaaaaaaaaacagtcttcattaacacaagagcctactcaccaaaatactgactaagtctggctgtagaatttcacttcatgaccttttagggttgtgaatgtcaaagactgagcccggggcagtgtgaaataataaacaactgggccataagatccagcttgacgggcatcatctgaaatcaccttcctgaatttattagagttaatcaatccaggctgaaaaacggagctaggaaatctctcccaccatgctctatttcattcacacttccttcacgtaacagacatttgtgagttttgtttcgctgttgtatttttttgagacaatcaaacatatccccaaatagatgctccttggatgtaacttgaaaggtgataaaatgcccaagaagaaaatcaccaagttgttgcttcacttgaattgcccagggcttttttccaaaggtaaaacttattcctcctattcagaggtgtatgttggtggtgacagtagttagcaggaatcacatctcatttcaaacatccaggcagacctgttgagatacattaaggagatgacccattgaaagagagcttcctatagaaaaatcttacagggttcaggctagggcaactgcttgtgacctcaaagattggaaataaaaaggctgctattagttccacatcggttctcagagtgaatgttgcagagtgatggagggtgttaagctgtcaaataccagcaagggttaataaggttaaagaagaaataaaagctggtcaacaataaagcggtgtggataaatcagcatcaataaataaagcatgtcatgtcatgtatacacagtgcgggaaaaacaaaaatcataactcatgtactcaggcagtagttgcaggaattcttcagtgggacatcccagatgctttccttgggcatcttacatgcttacttggacacatcaacagcccccttttctctctggaagtcatttactctctccccttttagaagaattttctaacatctatcagactgtgtaaaatataagaagagcagagccagggtagcttagcacctgatgtcaaagaaaggcagttataaaccaccacaccaaggaggtgattcactttcagtcccctttgacctctaccctggaaaggaaggtcagatagataccttttgtgtgggctgtatttgcccagctgaccaggaaaattcagggctttggtggccaaaggattttgcagattattctgtacatttgtgtatttcctgtaagtaacggaaagccttgatgaccttgcagctgaaatgccttcacagccatagacacttgctgttgtgccctagatggaaatcttgcaggcaaggtggctctgcgcacctatgttactgtgtaagtgccaggctccagctcagttttaactggttgatggctggccattccagctgacttgtggacctcacttttattgtttcttgtctacttccagactcaatggctatggagaatgcttctggttagtggtcactcttacttagagacaattctataaagcatgagtacaaagaatcatatgatgtatttattttttaaagaaggacaccccacttacacatttaagtcaatattactcttttgagaagttgagggcttattccattgcttcaaacctattttgactcccagcctgtggcatattactttgactatccttggtagggacaagcctccatccttgggatctgtgtttggaaagagcctaacattaggagtcaaacaggtgatcacgttgggtgatttttttctttgttgcattagattatgaagtgtaagcactgattttttttgtttggtttggttttcgataggactgtcaagggctttccaaaatatatcaagcaagggccgtaaaattggaaaaattacgtagtttctccaagacttaggttctggtagatgtgttgactaagcatcagcctatcactttatagtcctagcttgtcaactgtcacgcaggtaatgagtttttgaaggtgaagtttctattctcaggaagagtcttccagcagggaattagtagtctacgaaaagtgaccttgctgccttctttgcttggatctgttgagctcctggaactctagaaactggtttgtgaagtgtaagagttccaggatctcagcatctggggtggcccaagtcatggagattttatcagaatactatgggctttccctttcttaggagataaggttctggccttcaaacactattttcactgacaatttctctttccttgcttgaataatcccactagcaatctaaagaaagaacttttattccaaagaaacatactcataaagctgtgagttgttaaagagaacatgtgagtttctcatattcctaccttccactcctcctgtttgcccaccctttcctccaactccacattcaacttaggatagttttatttacacaatgaggtctgattgttttggggctttctttgtcatatatcatgccatttaatggtaagcaatacatttgtgactattcttttaggatgcatcagactttccctataaatctgaacagagtgagtggtatggaaaactagctgctagaattttgtttttgcgagtaaaaggcaacgtaacataaaaattaaacaaacatcttcctttccaatcactatctgcatgttacaaaccatgtagatttgtaactttgccaatacactatggtggaggaagggtgcctctgttccaagggcttcactccttggagatgtgttttcagaccgtggaacacagtggggtcaagtctatcagtatgaggcacagggacaatggggagactaatttaaaaagcataatgtgggcatcagacagaattgggtttaaatttctgtattttcctcaccagtcaaaaggcgttgcttggttcagtctgaacttcatttccctatctgtacaatgggcacaatttgtttttcataaggtttttagtgctgtatctatcatgtaatgatcatagaatctgatacagcctcttgattctcttttttctgaagccatttgcataaaatgagtctcacaaacttagctttttttttttttagtgagaaaattctggcatctgatgtagaaaataaattaatacctgcttaagagttctgttttctgcagtgaagcacagctgttattactgttaatggccccaagctttcacgattcccaaaccagaaaaacaagcgcaagatctttgctatgttgaagggagaactgggaaggcaaggtctcaattcagggccatttggaaatattaatataatcatttaatttcataatttcttttagcatttggctcgatgactttacaatatttttttaaaagtcaaatgctaacaaagagaaaacttcgagtacttcttcttgcattttcttgcattgaaggctcttcttgcattttttcttttttttcctctctgtccatctgtccgtttgtctctctttgaatatgtctgagttgaggagtgactttgagaaacaagtggcgttgcattgcctaaatagcttgtgttcttatcccagcggctggttttcaaaaaaaagactcctttttcagtcccttttcttcttcattatatacaaactgcaaggcagaaagcccttttgcctgtcccctaattccttagcccatccttaattagtgtttttacggttaatccctaccatatatctttaagagttgcacatgcgttggctccccacaagttttattgcattcaaaatagaggcaagctggcagtgtgtgatggtgggaatatgtacagtcactgagaggagttggctgttacttgtaattgattgctcactgaagcctgcccgcgcactttaccccgaggcctgactttcctccatatgcctagtgtcagaacttggaagccagctggtcagtcagcgcacatcctgtgggaagcggcagacacaggcggccgggtagccatcagcctccccgagcacatttcctctgtgttttgataatagttctgtaagctttaattatgctgtgtgacaacacattcatgaactatcaaaataaatcctttgaagagatggctgctaacaagttttgaagcaacagtgcttgttgcaaagaagtcaggagcgaggcaatcagattttgcaggatccccctggatgttgaaaccagatgaaacgttctcttgcctttttttttttttttttttttttttatcgtgctgacaaatgttccttttaaagctatgcccttaagaagttaactgaagacacttattgcaacactcgagtgtatccaacacagcgtttcacaattagcagcggtaatgcaggcattaaagctgtgccccaatatcagtatataatctggaggaacaccacagggtccattaaggccatttacagttgagactgagactaatggtattaaattattacggctattgctaaaagggcattataagtgaatcccttccagctgggttggttgtatatgctctttgtcaacagtacagtcctttaaggatatccttattgttcacgatcgtttagacgtgctgccgtgagctttactgaaggtgtaaataacatccgacaaaaagactgggaattagggtttgattaaacttggcttagagttaagtggagctgagtagttcttgggcaaatcctccttgtctttatatacacacgcacgtgtgctcacacacgggattgcctgtgttcatgcgctgcatgcggctgtgtacttttgcctgacctcacaggcacaggtggacccagaagttaattagagttgcttggattgttcgaggtggttgttctgtttggaacttggcagaatttagggcattagtgttagaatgccaatgagaattctgtttggaaaccacgtttttaagaaagaagagtgattcataatcctcagcatacattagtctcctattttttttcctcctatgagtgcagttgcccttttttttggcgggagattcccagaacttcctccaaggttggtagcattattaagtgttaagttattttaactccctcaatgcccaaacaacaggatactgctttagggaataattaagtaccagggtcttcaatttcaatttactgaagtaaggaagttgcagagagaaatttgagaataaattcaaagttgctactgagctcgaataatgaacatggcatgaattaataactccagtattgtcaggggtgcaagagagagaagactgaaacacaccccggagcgagtcttctcgggaagaggtcaagggtcagaaggtgttcattgcaaataagaacaggtaggttgccgtattaagtatattcacatatattattcataactattatactatatatgtcttctcttcattgtataaattaaataactgtagctaattaattgttattacttatccccatagtttgcctagatcagatatattttctgagcatctacttactttatgacttccactgtactaggcactttggagagggggaagaatcatatcagacatgactcttgcctcagggagtttacaatccagctgggaagaataggcaattttaacagaaaagagaaacttgttcagagctagattacatggtactagtcatgagtataataaaagtttaaagaagagacaaagtaggtgaggtattttggccacagagcgtgcaggaaatgggacttgagctggacacagaactgcaggaaggaggaggtgggaggaggtggtaaagagagcagaggagtccgcatcgctcgattgagggtgaagtcccagagaggactgagcagtgggctttggcggatactgcaaaggcctgctgggttgaggcagagccttgtttctgccaagtcctgtgttaggctctggggacacaaatgggtaagacattgtgctaccctcaggggacttagagcctcttgcggccattctcaatctatgtgcctttccactggaataaaaatttttttgcaccgaattcaaggaactcagtccctctgaagcccatcaattgatcctttggctcaaggttaagaactgctgcctcatgggaatgtgggccataagtttaaggtgggctggtttgcaggggtgaggtaaggacacttagaatcctggcaaaggagtttgactgacataggaggcaacaggggtcctttgaaaagacctatagagaacgttagagatgggccattgtccatccacctcattcttaggtggggaaactgagatcccagggctgaggtcactgcccaagctccccaagttgttcctaggggttcttttttatccttagcttaatggaaacttcttgcttggatctgactttctcaggaattattagggtggcagcaaagggtgcaagatgaaaaactgacctatgttaacgtatccttatcagagatgcaccgagaacaatcggagcagtaagagaaaaggagaatttaggaagaagctaagaacaaaggatggagccactggcgtgaaagaaactctatcaaatccagttttaatgcaaatcgctgttggcacatgagacacttcttagtgagaaacctcttcttgaattttgcgataaagcagagaatctttgcaatctttgaaacctttcactttggaaatatccacaaaacaaatgggaaaaacaaacattaatgaggcagatataaaacactttggagaaaaaataatttagcatttttatagttgctatagaaacacctcagccctcactcgtgctaattagttggattttacacattttatatttggaaatgcaaatcagttttcataaattattacttatttttcatttatatttgcagtactgttatgcaggtatacacagaaagtctaggatattatttagttatataatgtgacacacttagttatatgagcccgacatttatatccacaagacatttcttagtttaaatattctcctgttaaatgttgtgggaaattatacagagatttagaatttttacagaagaaaatgtaaattatgtggtggcttactaaagggctttctcatggagtcttgggagagaaggggaggagttttacccccagtagactttaataaacatttaaaaacttttctctggtcgtgggaattatggttggtttgggtgtcttctgaacttttggtactaaacatttgccatctgtaaacacttactggacttacaatgattggagaagacacaggcatgtttgtagcaaagggaatataggacagctccaagatccggggcggcttatagtctttgcggaggaggtgagtgaatgctcagactcagtagatggcaattatagacatattttcagtttatagacagaagacaggaggagtgaagctgtggacttcagctttgttgttgaaaaggggtactctgtgacagacctgggttcaactcttagcgctgttacttactagctacgtgatttggggcaaattacttggccactccaatcctgttcctgtaaaatggaggcaaaaagaataattcttacatcatagagtttttgtaaggattaaatgatagaatatttattaagcatttggttcagggcccagtacattataaagtgcttagccagtgttagctgttataaaattatcatcacagtcgattctcactgtgcatgcaattatccttctgatttcaactatgtgtgctggaacaaaaaattaaaaaagagaaaagaatgctaagaatagtttaaataatgttcttcatacactcactgtgtatctgcctcctagtgagcccaaaatgtaaataggctggtgatcagacctttgtatatagatgttaatgctcaaggttgcaaacgcatgcgtactgcactctatgtgtagtttcagggatttgcaaagattttttagactttctgaagttttatcttataccctgacttgagacactaactcccacatcatagttgaagccactgttgttggtgtgttgatagtgttactattggcttgatgtgaaagaacaaatagggtagctgatggagtgactggaagctacagttgagaccttggattagatctagatgtccttggatgattttgataaggagagaaaacagttagtggggagaagtggtgaaagatccttaaatgtccagtgtgagggagagagagaagagggggtggggttagcgatgggaggtgttgggaggggccatggctccttgcccaggaggctggggcagggacgggggagacaggaaatgggcctctgagtaatgggagccgcagagagaccgactgggtgcttagccccatgtgggaaataagcaacacagggagaaagaagtttatacaggcactagtatttttagagactgtcctttcagtgatgcatttgaataacaaggtgtcctaatactccttagccttctcagtcttatgtcttcagttatttgaaaaacaaagtaaatagcatagcttccttccctaggctgatttccgtcttttcctgaatcagtaagcaaggatttgtttcttctttgtgtgtatgaccccatttaaattcagagttcatggtaacataaatggtaactggtaggaaaacaaataaagtacaaatgcataaatacatttctttttcaaaatttatcacattaaacaagccaatagttttgatgttatctccacaaggttgagaccttgctatttattagacctactgggatatgtccaggcaggaaatgtaaggtactgaaggaatgggggttgagagagatggcaagctggaagccagtgtgccttctaatgggaagagctgaggctcattctcagttctctctgctccgttgctgttggagaatttgaacccagggttatcagatatgattttttgatagaagccagaaggtattttattgtgaaatcagattttaagtgatggcaactaattttcaaaaatttaaatcactatgaaagcaaaacaaaattagtctgtgagttgctggtttgtcaactttcttttatagctgcagggtagctagatgtggttattgagcactggagaagtagccagcacagattgagatacgcattagatataaaatacacactgatgttggaatattatgaaaagcatcaataatcattaatattgcttacatgtcaaaataatatttcggatatcatgggttaaataaaacattgctgaaattaattttacttggttattttctctttttaaaatgtggcaatcagaacattttgaattacatgtgtgacttgtattatatttctggtggactcactgctctagagaatttgagctgggtttttcctctaaggtcatctctcaaagtgtgtttgtgattttctgtgggtgaaggaccatgaacttatctacttgtcctttcttccttcttagaccaacctaaggtcaagaaaggtctgtcttttggggggccctccagccgggtcagttttgatccaaggatagagctaaagatggatctcacgctttgagctcaggtttcgattggctagtcagtgtatgcccagctgtcctcacccaagtgccagtaatgatgaccctgacacctggcattgcagtcataggcatggagtccttggtgcctaggttcttcagaaggcgtggcaaattcctgggaatcacacttcttttgtttgccgtcattttgcttaaaatcttattttctattagatgaaaaagagcaagcacctaaaatttcctatcatcgttatcattggagtcacattttaactcacattttgagttaaattgaggcccacattttaattgattcaagtctttcaagcctcacctcaagaagtttaatttatgagagagcaattccgaaaggcaagagggtggtaaccagtctgaggggccatagctgaaaaaaacaacttggaaagatgggaagccactggccaagttcttctcttcagcttttcagagaacacagtgtgtttgtagatctcatcaagcaagctctagattcaagtccaggaaatgttattgctttactttctagggactaggttctgtatggaatgtttgtacagacatcacctcttttaattctcacctcatgaaacacatctagtaacctctactgaggttttatgtgcttaatcttaagagaggcaaggaggaacacttgacagtctctacccacctccagacatgctaaggatttaacaattttcttaaagacaggatagttagagtgcccagatatgggcatatggattttccttttgttcctttctttggtccagctcagtggtgctcaaattttagtaggctgtaaacacaaatccacatgtgtggtgttttatgggtaatctaagtgattttcaagggtagttttgactacacgtgatttttgcttttcaggctaagtctaggacccgactttgtggctaaatggaactcgtttaaatgtgtacaagttcttagagcacaactccaggtggttggacacaaagatgcggaccgtatagccactgtccccagtgcttacagaataatgtgtgttcttcatgtgggctttggtgggatggggagaaaacccactgaagtttaaatagtctcagtgttcctgaagttaaggagcagaggtctggcctggcatggggaggcattctttggaaatggaggtggcagcagacaggcatcctgaagagaacagcccggcccaagacaacttcccagcctgaggttcaggtcctccaggtatttggcttcacttcagccacgctcaccttatctctagaagttgcttcaagatcagctccaagctgagttcctgcagcttccaagagtgtcagttatgaggccctcaaccttaagtatagctggatgttggagcttcctggttgttgcagggaatacagtgaaattcatccatttagtgggagttcaccatgagttctgttgtgcgaggaacttagtggcagtagctgacattgagggtttatgatatgccagggactgtgctacatattaaagttacatcctattacatttaattcatgcaatactctgaggtaggttttactcatcctctttcacggattagaaaattgagagagattaaatcatttgctcagtgttccatgcctttctttaggggactgcatcagccatagttagattcggctgcaagtgagggagcctctggccctacccaaaacaaaacaagagtggcctaaataaggcagaagtttattactctcacataaattaagcctggaagtaagcagcctagacctgaggtggaagctctttcccccaaagccctccagccaggttccctctagcatattcttctgccatccctagagggtggtctcatccctgttctccaagatggagctgtagtcattacagcaatattcctagcagcagaatggaggaaggaaaggggcagggcagacccttcctcttaatgatacggcttgcatattacagatagcaccctgctttcatctcattggccaggaattggtcacatggttacctagctttaaggaagtttgagaaatacagtttttattatgggcagccatgtactcaaataaacattgaggatgttataacttcatatgaaagagcaaagagatatttggggtcagcaatagaccttgtcaccatagtgactttgggcaagtcacttagattcctcttgctttttcatctataaaatgaaaatgatgattacttgttctcacttgtgcctcataacactcctggagttaggataactctagttaggggtgtcatgaggagtaagtgagactttggaaagcatttagcataatgtcctatagttggcatcatttaaaacatagctctttttaattaaaacatggcaaagccttccgtatttctgttaattttggggacatggtaacatagtcactagagaaacatgcttgctttctatattttctccttcgtgatctgttttcactattaaataatactttggaatcttctgcctgccatgtaactttagtttaatatctatttttctgtcaggctgaggtggtaagattcactgatcatgaaattttaaaagtttgaagaagaaataataaaagataatgttgactttctttctctttctgttgatactctcacagatggttcctttctctgtagaactcaattttatgttgtgtgcttaggaagcccaatgttgatgtaactataatttaaaataatttggaacttaccctttaaaggagtgggctaattgggaaatttcacatctggatctatatttatatctatccaggttaccactgttttagattggcttaggagagaggcatactttttcagccagaagttggaactcttctttggagcgctgaaaagtggtgttaaaattgaacacctttgcttgggaggagtgtgagctggaaggataggtgtgcatgggacagagagtgttatgccttcagtttggatcagtctcaaggtgttagtacagccgatagggatgggtgggggtgttaagctaaagtccttattggtttcccactggatgaacccatctggatcagtctccactgcaccaccacagggctccagtggtctgatcttctgcctcaccagcctcagcctggatctcaggcacagcattgtgggccctccagcctcattcatgctccctgtaccttggggtccttctgcaattggacccctctacctggagtgccttccttgcctctctgcctcttcaagtgttcctcgtccttcagatgctatttccaggaaagcctctctgagttcctgagttgtcaggcttctttgttttcactcttataacactgggcctgtgtccttcagagacatgcctagagtcctcttaggagactatttgattcatgcctgcctcctttagtctgtaagctcactgagggcagggcctgtgtctgcttttgctgaccttcttgttccctgtgcttgccgtggtgcttcacaaatatccgcagaataaaccaatttgaaaattcatatattacttatggatcatcctctggtaacttagaagggctgctcaaaaaggactttaatataaatatatatttaaagcttagcagttgcatgatgggcacactggtttgccagggctgccataacaaagtaccacagaccaggtggcctaaacagcagaaatctatttcctcacacttctagaggccagaggtctgagatcaaagtgctgttagggttggtttcttctgagggcctctttccttggctcgtagacgccgtcttcttccagtgcctttgcatggtcttcccctgggcatgtctgtgttttaatgtcttcctcttataaggacaccagtcatattggattaaggcccaccccaatgaccttatttaattttaatgacctctttaaagaccctgtctccaaggctgggtgcagtggcttatgcttataattccagcactttgggttgccaagttgggaggattgcctgaggctaggagtttgagaccaacctggccaacatggcgaaaccctttctctacaaaactctacaaaaaaaaagtacaaaaattagcagagcatagtggcttgcctgtagtcccagctactcaggaggctgaagtgagaggattgcttgagcctgggaggttgaggatgcagtgagctgagatctcaccactgcactccatccagcctgggtgacagagtgagaccctgtctaaaaaaagaaaaaaaaaaagactctccaaatacagtcacattctgaggtactgggggttaggacttcaacatatgaattttggagtggaatgggacacaattcagcccatggcagtggccatgattagactcttaactaatatggaagccaaatgttcttcaaatcacatgtcagcattttcttttcttttcttttcttttttcttttttttttttgagacagagtctgtctctgttgccaggcgagaatgcagtggcgcgatctcagctcactgcaatctccgcctcctgggttcaagccattctcctgcctcagcctcccgagtagctgggattacaggcgcgtgccaccacacccagctaatttatgtatttttagtagagatggggtttcaccatgttggccaggttggtcttgaactctggaccttgtgatccgcctgccttggcctcccaaagtgctgggattacaggcgtgagtcactgcacccggccacatgtcagcattttctaagcagagaccagggtcattgcagtaaggtctctcttggttagagtgatgcaaagccaagtggcttccgaatgacacagcaagaaagtcaaagaaaaggctccacaaaggctatgtgggccacattaaagcgcaagatttattttcattatattttttcttagcagaacccatcttatctggttagacaggcttctttagaaccagattttgttctttgtgacatttggagttaatatgaggaaatgctctttgtattgcccagtattgaaaatgtcagtaaacaaacgcagcagtcagagaagggggggttctaacaaaagacattgtttcttgatgcaggaggtaacaagagtatttagaacaaaggttttctcaaaataggctttttagcaaactttggagccctgctctggtaccccacccgcttccattctgctgaaacagcgatgttgatgaaaatacttattattttaaccagccccccaaacttaccaacacaaacacactcttaatttcagggctgacagcagggctgggaaggtccttataggatcgcaaaacaactcgggcagttgagggcttccggcagccagctaacaaaaatatactctcagaggatgcagctcagggaggcgtgggacctgcacagcagagagcctgaaagctggcctttccgttttttacagagcttcacccttcacatctggcggagctgtgacaatcagtgttagaccattttagaaatcagataccctgggtaccaggaagttgatttgccttcaacttccttaagaaaacacgcattaatatttaagctgggttttcataaaagaagcgttgtgcttgagatgtgaaataaagttaggcggctgggaaaactcctccagatacggtgaccctgatgcaattcaaatcacactccagatttgaaaaggaaagggagcagggctcaccctccccgcaaagtctttgtggcattttgtatctactgttttatggtgtgtgtctataatttgcaaggaactggactttaagttgtaacttccttctctgtaaacagaagttggagattcacgaaggttactttcttaagtgatcccaaaaaacactgtttatgatttccccttggtattgtttctttgcagcttttttcaattaaagagccctgtggcgtacatcatctcgttacggggctcatggaggctcttgctgtacaggtccagccttatgcgtttccctgccctcctttggatctactccctgtggagctgacattgagatggtgtcagataaatcaggcaggacaattctgatggtgccatcttgaatgtagtgtgactttagtatgtctctaaaagagttgtggagacaaatacagttcttaaagggcgaaagagctttttcaaagatcagtataaatggtttactttaaaaataaacattttaaatcactttgatcttagctgtccaaaagatgcaaactagtcatgcttctgggggggagtattttccggggttttaaacctagcatagaccatttcctctttgtttgcaaaaagataaataatttttggaacaatagaacacagaagaagcaattgtgtaaatagtggacaggtaatatactgaaggtgttgcaagagcagaaattggttttgcatttgcccatagagcttttggtaacctctgtaggtaaggttatttatccagatcagaattctgcaaactacattcctctgtctgtgtctgtccaccctcctactcatctccatctcatctgcgaggatatcgtgactttttttggtcagataccttattgaaaatttgcccatgacttagcataacttctgtcttttgtttcaataattagactttactctttcgggctgtatactttcatgctcacctggcatcatcattcaaatatgatttcagcattagcttagtacttaagtgtcaagcctgtatttggtattttggtacaatggttaatattttgaggattgcctgaattttagattttgagtaagtcatacataattgcaaagggagtaagttctgatgcactttcaaaatctaaccacaaattatgcagagataaaatgaaataattttgaggttttccacgtttcttttgcatgaaaaaacaagtgtcagctatgctaatatcacgtactatatcatctttaatttatttttgctttttttttttttttgagatggggtcttgctctcttgcccaggctggagtgcagatctcagctcactgcagcctggacttccttggctcaagggactctcctgcctcagcctcctgagtagctgggactacaggtgtgcaccaccgtgcccagctaattttttttgcttgttttttgtgtgatgtctaaaatagttatctcctggataacaggaagttgtcctcagtaagtctgccatctttttcgtattcatagtatgaattctcactctaaagtttaaggagacatgatcatttacaaagatactttaagaccagggctggcatagtaaagaaagtgtgatattttattgttaactggcttctagtggcatttcttaaacgaggctcttttgtcaagttccacacaatcacgaggttgagggtaggttttgaaggaggaaatactgtgcaagacaatttgggtagttctgtgtgggtctcttaacactataaaacaattaacagaaaacatgcgctctttgttggacagacagaaccacaaagtggacacaggattatctgaatgaagacatctgagttttaatatgagatcttcaactaacaagctgtgtgactttaggcaagacttctaacttttctggggggttttctccttcataaattaaaaagggcttggcttgacatcaagttaaaaatataattaaagtaaataaaagcagagctcctgtagttgaggagagcatgaggctgggagagctttccactggctgagcttccccttggccaaggtcaaaatcacctcctacttccagcatcttacattccttgagtctaaaagagataatgttaattagaatttaaactgataaaagccattttgacatttttaaagtgtccctttgctaatattacttgttatagaggacttggaaaatatgaaaatgtttaggctgggcgcggtggctcacacctgtaatcccagcactttgggaggccaaggtgggcgaatcacgtcaggtcaggagtttgagaccagcctggtcaacatggtgaaaccttgtctctactaaaaatacaacaacaacaaaaaaattagccgggcgtggtggtgcatacctagaatcccaactacttgggaggctgaggcgggagaatcgttgaagcccaggaggctgaggctgcagtgagtccagattgtgccactgctgtccagcctgccttcataacagagcaagactctgtcttaaaaaaaaaaaaaaagaaaagaaaaagaaaagaaaacgtttaaaaaggagaccaaaatgatttattcacaccaactcccagataaatgcatttgaggtgtattttctctttttcttttattttctttcatatcagtctcctcatctgtttgttaactaaagtgtgtgtgtgtgtgatttttaaaaagatcctcgctattggatattttagttatttccagtttttcatggttataaatatcatgtgatgaacacctttgaatataaatcttcaactgttgctctgattacaatcttagaatagatttctagacatggaattcctgggtcaaaagtttgacttcttaaacttctagtgatctcattttattttacttttttttggtaccacttgtttcaatagaaataatctcttattcttacacatggaaccatgatgagttgttcagactgttaggtgaaatagtattgaagagtagtgaacctgaagcagctcttacatgctagcaaataaaatctatctcccacatcatgattaaatggatcattgttcacttggtatgctatggtagaaagctgctttccaatttggagaaaataacttgtaaaatcaattttaacatttgttgggtgactgggatctatctggttgctaagatttttctttccttcatatctcatgatacttaactttggtttaaacaaatagaacttatgtgtttctaacacccctcatttctgaactcctatttttgaaaaaaaaaattggaactgtgcattttggtggagggggagagaataaatgcatatttaaggtatgaatgcttctttcaggaattgatctgcatcttggctggcaaatctctcaggtgcacgaaggggccctggctacttggtcattcatggaggaatatattttttaaatgctttcttgaccctcttctaatttggaggcaagcacattcctcactttttcccaaccagagcgaaccaaattttcatgtgcacagagtgtgttttcagtggattagacccaaagctatgttgttctagaggtcttagaactgcttatgtagtacacaataagctttgtagcacaatttaaatgttgattttaacatataaacagtcatccaaaagcattccagaaaagctgtttttaggatttggcttaaaagtgtattggataatgacttctcaagcatgtttattttttttggtgtctttatttaggcatataaagtttttccttttactgggaccccataaagaagtctgtgtcccctttttttctctctctgtgcttcttcctttcctttcccagctgttcctttaattcatctgagacattagatgacattctttattttgccaacaatgacttatttataactaattgcctgggttctgggattgttaggaaactgtattgacaatgataatttttagttgtctcacaatgaggacacatgaattatcacagattccaatcaaaaaatggcaaatgagaaacaaagcccccaccaacggtacatttctgacattgcctttgttaagtgttgcattaataggaaggtgacattcttttgagaagtaaagcatatgtaaataggaagagtttttaaaaatagaattcttcaagccagactcatttctacagcttcataaggaaaagaacaagttagacagaaaccttctgttaacagagaatagaaattggagttgttctcctgctttatttatggaccaaactttttatgttttgagtatttttgggtatagttgggtataattaagtgtggtctgaccaatcaattctgtgtttaaatttcatcattagtgagaacccaagagattcccaggcttttttttttttttttttttttttttttttaacatggctatgattggttatatgagtttgtgaaattacaaacctaatttctgggtggtgtcaaagatgggattacctgaaacggattcccacgttgctttgtgatttggtgattatggttcttgacttctctaagagaggaataaaagtgccacactcactaatgaccaaattggtcagttccactcatatgccccctatagcctctttaccatctagcctttccagagttaacctattgtaaaattagattgtaaaaatggacagagtggccaccactctgggataagggtgaaggactcatggtgtcatccccactaaatactccagtggaaattatcacttaattatttgtgatatcacccagctccccaaagagctggccttccttttcagccccagttatcttttggaagtgtaactctttcagtttgattgtcctgggaacacatgcagttttctcttgatggggaaacccctctctgaaggtctgcgttttaagtggcagagatgcaaaaacagccttctagacagagtttctaattgaattctcctctataccgttatccataaactgagtaatgcatccaaggaagaagagaggatgagagaggtcaggaagtttagattccagtaaaatttaaatagccactgaatttgccatagcaaaacatgagctatgattctgttagtacacaggaaaagtcaattaggtgaactgattttttatggtgttgggaatattataattcagggattcttaacctatagcttaacctataggcaatttaagactagatttcaggggtagggcagtgaaacttctaaaattgctgtaacattttttattaagtcataggcagtttcctagggagaggcttttatcaaattctcagaagggtccactgccataaaagattaaggaaccactgcattctatcatcataattttttgtcttctttcaaaagttgatattctggttttttttatgcagaaaagacaaaagcatgtacaactctgatatttcatgatctttaatttcttccccctcctggatgtcctataataaatgtacaggaaagaaatataaaacgctatccaaactcagttaatagctctgagaaatgcacactcagagtgctttaaaatcaggttacaaatatcattttcaatttgctggggagaaaataggaagagtcccttggaatacagaataaattcattctatgtacattatcagtgttggttcattatattctcattggcccacaactcaacacatctttaagaagcaaaagtgcatacactctcccttactgacaatatttaggggaagaccacatactttgtgaactactgtgagttgagttcttgtagtcaaagcagtagtaggtggagcttcattctctggtattaaaatcctaaaagtgagtagtgttattaattgggggcacttttgagatttgattaagaaatttactgctcttgtgggttgtttcctcccctgtgggatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttgaagggcacttttctctctctaaaattctccattcctcacaactggtttttattattccgtgacatgctgggagtgttgctatgactgttggagaagtatgggcagatatattgctggctggcttcttacaggaagagtttcccatgatggtaagtctggctgtaaatttcaagcagcattgccacttccacctcaagcttatcaagactcttagccttccttcaccatgaagaatccaggatcttatcacctgaagctattgagataatgtgacattcagtggatgcagagacttccagagcacagttccctacttggcagctagtagggaaacatggaattcattatagaacaagctaagcagttgtaaattgaaatatggcagcaataactacctttctactcagtgactctgaaagactttgattatctacctacctacctacctacctacctactacctctctgtctttttggtttgctactttatagcaaaatgatagtgttctggaaagacccgaattctggtcccaggtcctgtaagtcagagctgttgaaccttaagatagtcctgtagcctccctggactttgtttttcttatctgtaaaaggaacataatagtatgtgctttgctgacttaatatagtcagagtgaggaggaaatgagacctcaaatttgatatcactgagaagcagtttttttttttttttttggagatggagtctcgctcttgtcacccaggcgggagagcagtggtgtgatcttggatcactgcaacctctgcctttgggttcaagtgattctcctgcctcagcctcctaagtagctgggattacaggcacctgccaccatgcctggctaatttttgtatttttagtagagacggggtttcaccatgttgcccaggctggtctcaaacttccaacttcaagtgatccgcccaccttggcctcccaatgtgctgggatttcagctgtgaggcactgtgcccagcccactgagaagcattttaaagccaaatgatgattgccattttccttgatagaaattctcccaacattttagtgtctcacagttctggctttgcagtcaggcagggctgggtgagaaccctgactacaccacttactcatccatgatctcaaaggagccacttgtgtaatcttagctccatcttcctcatctttagaacgggagcagtgatagatcacacctactagagctgaagtgtggattgagccaggtgagattcatgaagtttgagcacatggcttgtgggcatgtgctcagtcctcaatgaatgtaagctgttgtcacgctttgagtccctctgcctatattgctaagaattagaacattctgaaaacagatccgtgcatatgtgctctaagaatgcacaatacacaggcaagctgtcattttaagaggaaatcatccaaggtcttctggttagtcctcaataatcaccttctactacaatcagattaaatcttcaagtggtggcagaatgccagtttttttttttttttcctgcagttgtgtttcctgtgccttctagtggtattcaaaatacttcacaattcaactcaagaaatttagcacatcttcagaataaattattattgtcattagcacattaccacccaagaaaatctgtacaggaacagaatgcccagagtgagacactgcatgttcatcagcttgtgggtgccatatgtatggggatgtttttgtttcggctgttgctttttgtacaccaaagctaaaagcaagacacacccagtgatgtttgttgatcttgtgactaacagagttagcaaagagccaattaaagcagttcaaacagacagaaagataaagatgccagtgcagagaaaagtcacagcagcaataacccttgataaaagggcaaatggaaccaagatcttacctttcttgagcttatatatataaatgtatctggcagtagaagcatcccaaacttgcatcatgagtaaagagtgatcgaaaggaaaatctgttttgattattttcacaaaacttccttttgatgtgcaccgattttaatcaactttcctacacagctgcaaattagtcctctagctctccatccactctattgctttctttccttatgattcttgttacattttagtttagcacatgacagatcctttttactttacagatttccaaaggtgataatttcttacattttacatgactatgtatactaaagatgaagtactgctttcaagtacaattttaggtgcctatatggcttcatcctttgaatagcactccttcctccttttctatatatataaaaactatgtcagccttgaactcaaactaaaatttcttccattaaagggtatgttcattatttactgtaagatgaatgccctatggatttttaaacataagcctggaaaataggaaataattcactctggcttgaaaagggtggagatttctttgtttctttttatatttattcaggaaaagctgacaatcgtctcacattaatgaactacaccatcaatcactgtgttgacaatgagcggaaaagcgaggtatatgtcaggctaacggcatattgcctttttcagtgagggcatggctgtttatagcactttcattggcaaaatacttttgcactggaataggaatagaaaggagaattagaaaggcagccagtggaaagagctttatgttttcaaattatggaaaaagtaataggggaaaattgagaaatgattatttttgtactttgtgtacctatcccacaggacttgaagagtaaatggaaaatgaaaaaaaaaaaaaaaaggcttgggggagggtggtttcttttatttctcaccttattctactgggctgttgtctttccctaagatcatggcaaaaagtttcagagattatgtacaacaactgtattggaaccctgcaaccattacaaaattgaattagaagtaattggttttatgctactctgagcacccaccatagcttaaacacatacacacatgcgtgcacgcaggcacacacacacacaaacacacacacacgggtgataatgaaaaatactttggtggcctcaggaaatgatagaattttctcccatgtttagctcccactctcctgaggaacaggttggtaaggagattaactaagccctggtgaaatcactgtatcaaacaatattgtggtgaactgtgactcaggcttaacagctatgtggtcctatagcccctgagaggaggaaccttcatctgttttggggagggcactttatcctctccttaaaaatctaaacaactttagtgtcaacttaataagttggccaaaaaggacaagatgaaggtaatatcagaagctagcaattattagagggggttagtatgtgttaaggactcataacagccttgtgaggtgggggaatatcgtttcttttacagataagcaaactgaggctcagagggatgaaatgatttgcaccaggggtcacacagtcagtgaatggttgagtcataatttgtggatctttcttaactacagattccagtctcttcaatgctagaccagtgattttgaaatcttttggcctcagactcctttacacttttaaaaattgttgaagatttaaagaaattttgtggatgtggcttatgtctatccatatttactgtcttataaattaaaatgagaaattaaaaaaaaattctttcttactcatttaaaaataacaatagcaaccccatcacatgttaacataaacacagtttataatgataaaataactccatgttctgaaacaaaaacatttagttagaagaatggcatggttttacatttttacattgtctgacttttaatagaatacagtattctcatatttgcttctacattctgttcctggatgtcattttgattaaagtatatgaaggaaacccagcttcataaatatatatagttggaaaaaaagaggagtattttaattgttatttttcagatagctgtgactattcttctttgataccacaccaaaacttaacaagtttctcaaaagttagttgtgtgatacctgaaacaatatcaatgaattttttaactccttacattaaaatacattggtatatctttcactatgaataggtcttttacccatcatcattttgtaacatcactcattggtcatttgaaaaatattggttcactgagttatgttcattgagttatgtgacatactttgttagacaatatcaacgatttatgttcattaatatcaccattgatctcatcagaaaaggtattggagagctgccaatctcatagttgtggacccaggttttccaaaattctaatttttacttgaaaggtgaattttattattggcaacacctgctgtcaatagttttctttgaagtgacagtcttactttttgagaaaatgtttgcaatacacaagtttgaaaagccatagtttgtcagttgtattttcaagtaaaaatgctgttctatggaaaaatcaaaacaaaacagaaaataactacttcagcttgcaactcagacagttgcacaaatgctttatctggacatgaccattgtactttttggtatgcagtgaaaagctttatctgtattactcattttatcattttatctcaaagaatactacgaagatgtaaggagggtcaagatttaataaaatttaatatttaaaaaagtttaataaaattagtagttttattacttcaacaacattcttaaatgaagtggctttgatgctttgtgtttgtgtgtgtgtgtgtctgtactgcaagtgtgtgatggagaagaatacaatgattagtgagtacggtttggcatgattgccatgattttcacaaggcatgaattgcttcatctatcattgcttttgcaccttcagcacaaatgtcaggtcagtagtattataaggaaaatagttttcaccccatggcccataaaagagactcagagacattcagatttctgcaggagcacatttgagaactgctgctccacacaatactgtctctcaaaaatgccagtgatggatgtatcaacagctttctgtagcaaaacagcagaaaaagtgaacagtaggaaaagagttggataccattattcttacaataaagttttaatgcttatttttctatatgtatgtctgtctgtaatggtggatagaggcttcgttaaaatgtcagtaggtttttatttcttattgaatctttgtgcttcatttcaaagaagaaagaaaaaaatacactacggatcagtggatagcataattttgagaccatcagcaactgctgaacttagttttcatttttaccatgtcaacattggaacacactgatcagttctctgtttataatcctgaaaacttgccacttggaatagatttaaaatatttgtgtatagttacagcattttaagaggcaaaacccaccaatttctcacaaatgcttggaaagctttctgttctctaactgaaaacatctcatgttcccgcttagccaagagagagaaaaagatttgaagacagatcctttaactggatgtaaggagttctctaaaagacttaacaacttattcgaaagtagtttgtcttaaagaagaaacctgtcttggttgaagtgaagaaaatttgggatttttatggaaactaattataagtactaatgcttttgaagttatgtctccgttgcttggaacaactattggtcacattttctgtttttggggcattatacactcttaggaattgccagtgtttcaggctgcagcatagcttcatcccagagtggagtctctgggtaagagccatcaataggctttcattctgtttctttttnnnnnnnnnnnnnnnnnnnnccaatttaaagaaaagtttattaagtaaatgccaataaagggcggtaggtgggttggtaaaaatgatagacaaaatgattgaagtttttcggaagctgaagtagttcagacacttagtgcattcatttgcttattcaacgttatgtatcgaatacctgtctattccagattctgtggattcaggcagtcaatagtgggaacaaagtccctggccttgtggaactctcatcctcgatgtggaagagaaataaatatatgctataatctcaggtagttagtgtcgtaaaggaaaataaggcagggttaggggctagagcttgcggagtaggggcagttttagagaagggtggaggaaagccttgtcgaggaggttgcatctgagcagaaagcaagacagattgggtttagttcattctgcaatcacacatggggtgtttggctctggaaaacaaatacagaaaagactggccagaagaagctcataatttgggggtggaggacttcattaaaatttaataagatagagtatagtgaaagcgatgcaaggaggagacattgggagcatggaaaaaaggaatggctgtcctaattgatgggaggtaatatgatggaagatttcctagaggaggtcagtgtcctgaattgagcctttcagaatgaggaggaggtagcaggggaggggaaggaaatggtggcaggacagggccatttacagtagagagaacaacatatgcaaaggtataaaacattccttgagggggcacatagtgggtatctggtaaattcctgttgaatgcaaaaatgatgtgaggagtgctttgacgctgcaagaacatgagcgttgaggtaaggagtagagggagagcctgctgtagagctagcaaaggcctgtgtctgggaggcttggacttcttcctttgggccacagggatccactggagggttttacaagagggatgacatgttacatgtgcttcattcattaactactattgtgttagtttggagaataaatttgcatggcgtaaggacaagcaccagtgaaaatcaggaatggattcaacaagacccagaaagaagtaatgggaagaaaagagctatagggagtcagttggatttggcagaatgggcatcattggtgaatttaaagcagcttaatttatgcattgagggtagaatctggattttggggaattgaggagtagacggaggataaacaactctatgtatgtggattagcaatttttagataactggaaactgcaaaatatttaatacttagctacgtagaatgtgaagtatttattcggaatggggctgaatgtccagcactgctcacagacccagttcaagggtcctccgcctggcctctgctctttagagggtcccagtctggctctcctcagggagtgagagacccctggggccacctggaaactgcccactcttgtaagatgttgctcagcgttcttgggacccaggaattcactgctccaaaggccctgagttcactttcaaggcttggttctgcagggtgtactcatgtgtgcaccctgagtcttgaggagtagacaaagggcttttgtggaggatgaggagggagattggatgtgagcactgctgtgttcatacgtgtgctgtgttctgatccttgagatttggatcagagccagaggtggaaagagaagaggatggggtgtagttggggctggcctccctatgccactgactacttgagaggaacattgaagaactgaaaattctacaatcgaagttggctttccaggttgttataaagaagtatttgtcaagacaggaggtataacatatttcatttaaaagtttgctagcttgttttatagcttttaaatatttagacacgtaagatgtgagccttctttttattaggaatgggctggagtatcataattccttgcatttgttgtctttaaactagaaactcagtaataaatggtagaagtgtccagttcctgtaaggctgcttaagtggatttttactaaatattaagtgttttcaagaaattgtgttaagattcgcctcactttccaccaatactacatgtctttggcctccccacaaccttagaaatgtacacccagaactgaattaagtaatttagaataagctcacattttaaagttactttcagaaaccaaatttgaagaaagtgaaacaatatcctttgccccttacttctgggtaaaagacagaaatcacaactgtccaaatctagacaacaatctttatggttaacttataaagtgagagttagttaaaaatttcataaaaattagagaaaattgtagcaaagccatcactaatttacccaggaagtatattaagacattacatgcttacaagttatttataaagtcccggacatgtttgttgatctggttaaaacaacactaagtacttccagaaaaattcctttctagataaaaagatctgataaatcagcatgatcatcagatttctctaataaaagaaagggtgttggaaagagtgaattccagataagtcctgtgtaatgctcctgaaagccatgaggtcaccagtaaattaaagttggatttggggcccagaatctgttatagctgtttgtattctcctaggctggaggccagacagctagaaacagggccgagatcctcagggagtctaagtcctcttcatgcagcacttgacaccgttattgcacctctggaatctagtaggtttcactaatatgttttggggggctctgcacgtcatgtgataaaattgcattgcgagtctgtgaccgaagatgagatcatctttcttagctcatcgtttcaggcaagggccaccctccccataggtggagtagcacagagtgcactgtgatatgaagaaagaaggaactgagatttttatcatgcagtgatcctgtgccaggcagggtgctgggttctttcttaaatcatccagttaatccttacaatgaccctgtaagaaggtcggagagggtaaggcatatatccaagctcacagagcttaacaaatggcagatcctggagtcattctgctctccacaggatgccctgttcggggctttttcctcaacaccacactgaggggtgtcaagagcctctcttgcactggaagattatttagctttttagactcaggactcagaagagccttggagattatatagtcaccgaatcctgacacctgtgcatttgctgctgaattcacagcagttctaagccaagcatatgagcgtccccctagcattgatctgctactgtgcctaaaagtttcccctgcagtgactattccacatgaaaccattgtgccttgttaaataaaatatgactgtatcatgaagacaccaccaatacttaggttcaggtgattttatgccactagtaagaatccaaggacaatgtgttattggggagaagtagaaaaaggaaaatctggggtagcacctggcatgctctttctccaattttctactacttactcctattccccaaattctcccatcaaggaggaaatgaactctgagacagaagatgagttttcctcaaagcttgaccaggatataagtggatgccttattgggcaaagcagagggtaaccaattagaaggccctggcttctcttgattgatagctgagaactcgtcagagggatcagtgctttctctgtgtattgctggagtctgaaagtgtgactctcatgtcactgattcatttctgaagtgttaaattcagaataaatttttgataatcaaaatgaacttagagaactttgttgtttggcattgtcaagagtgaagaattcttgcctaatgcaaaaagtcatccatgaattttctgccatattagtttgagcaaaactgtgttttttgccctactggatctcttaatgtaatgacatgtttgggattttgaggttgaaatgaatttctgataaaataaccattccaatgataaaatgtaaaatggtaatgcaagatcagtcactctcgttatgagacttctggctcatatgattataagtgttaaagccaggcaaaatcttaggcgtagagttccaagaaatattatactttactcaaaaggcgtgcaagggatgttccagagttgtcattagtagattatgatgtcaggtgacagctccgcaggttgtgtcactcttgcttatgttgtgttttcacagctccctttaacaagacacatttagacttagtggattttgtaagttgaaaggccccttgactctaagatcaagagttaaaagaggctgaggttggcttgcttgctgggtttgggcaaagccactgtacacagtacccaaataatatctggaatcagatcgctcattgtacttatagaaaattagagtgttctttggtctattcatattgttggagtttcccctttgtctttcctgggtggggaagttaaagaggaatctcacagttatttaagttggtgggatagagatgtagctcatgttgttctccttctgagacgcacccacctgcaggaaggggaatgattaacccaccacatgagggggtttggctgaggtgcaggaaccagcatagaatgagacaggagaacccaagtaactcacccatcttcccacctgctgtgatgataactggggtcatttatccacaatgcttaaagtgacggagacaaccataggcatttgcaaattccttgtctgcctgcctatttacctaggacagacttacattttgacttgccctttcctccccagttggactggaatttgagatgttccatcagtctgtttaatcctttaggtctgaccatgatctgagatgaagtttgttccttggttttgcttttgctggtttgtgatcttggttctcgacttagacttggaaggctggacagagtcagagagattggcagtgataatctttacacgtgctttctccttatgtcattttacatttggagcaatcccttgaactcataggatgagtattgttagttccattttacagacaagaaaagaaggctcagagtagtgaaatgacttgccctttgagtagttgatgtctaactccaaatatttattccactattttctctactaatcatggtatttctcatcaccattgctatgcctgtgagtagaatttttatccctgttttcagagggaaaacactaggattttaagaaacttttcccccttgataatccatcgattcagtagttgtgccagataccaaccagagacctctttgtaggtcacactcaatccctaacaagtctaaaagaaacagggccaggcatggtggctcatgcctgtaatcctagcactttgggaggctgaggtgggtggattgcctgagctcaggaatttgagaccagcctgggcaacacagtgaaaccccatctctactaaaatacaaaaaaattagctgggtgtagcagcgtgcacctgtaatcccggctacttggaaggctaaggcaggagaatcgcttgagcccaggaggcggaggtgaaaccccatctctactaaaatacaaaaaaattagctgggtgtagcagcgtgcacctgtaatcccggctacttggaaggctaaggcaggagaatcgcttgagcccaggaggcggaggttgcagtgagccgagattgctccattgcactctagcctgggcaacagagcaagactccgtctcaaaaaaaaaaaaaaaaaaaaaaaaagaaagaaacagcagggctcttaatataccccttagtggagataaatcctataaaattacacttcagcagcaaaatagacaagcacagtaattttggtgtgaaatgtgcaaagtcttatttacagaacatctcatgatgctgttcccagatgtctttttaaagaaatttttagttacatgcaaaggaactgaaaaccaggaatataattggtaagaaacgtaaatctgtccaaaaaaaacaattgcaacaacttgatgagatatatattttctcagcatcagcataaaagaaagaacattctgatccagaaatggtatgtaagtaaataaactttaattggtttgacaatgccccttttcctggcagtgccaagaatcctagcattataattacacagttctgggcagacatgtggtttccattaagaaagacttgtgattgactgagttcatgaggcatgtcagaaaaaacacatcaatgtctttataagaagggaagagaaatggatctaaatgtatttataacttcacaagatacacattcatagtttcaaaagggcatacatttctttaattctgatgaaaaaaaaaaatcattagggaaagccattgagagcattttggcctccactgctacatgagcacagtacagtgacttgcatttaggtaaaaggaatactttttttttttttttcccttacaaggatttatttaaggattctggaaggcaaacgttgaggaaagtcttagttgaataagctgttgcttcatggtttaaacgttccccaacctccttttttcctttaaatggctttaccattaacaaaaagatttttcagatccgttctctcttagccccgtgtggtgagccaagcaggatttagtagtctatctcccctcaaccctaccaccatctcaactttttaatagaggaggagactgagtcttgggaagttggtgagttgctgaaggtctttcagctaataaatgcttttaatttaaaatgtgttgcaaaaacattggagaggggtgaaatgggcaggcagggaggggctttgttcagctcttgcattgtgcaaatgccaacactccacaggtaacacagacacaacataagaaatggcttgaattttatatgcaaaaggataaaactagcttggttgaaaagggtgcatttcctccaagaacattttaaacaaaaacctaatgacttgccgtaatcacctaaagtgactaaaatattgaattgtttattttttgcttttgcataaatacttttaagatgacaaatacttttaggtctgccaaatactgtcatcttttggcaatgttaacatctcaggcttgatatattttcttgacagtgaacaattgtgtgtgcgcgcttcttcttttcttgaaaaacattttgtcaagaagtagtggcaaaacatgtggtagtgtttttaaagagactatctctacaaaggcatctcttacataaaatatgagactttttaatttaaaaaataaatttgctttattcaatggaatgtctaaagctgttttgtgattcagatatttttaagcaaccatctggtatgctagaatgaatatgaaaaatattgcagtctgaaattcatgaaacaatggcctatgatgtcatcaataataaaaataacaatgaatgatagcctccatttatcaagtgctttctatgtgccaggcattgtgctctgtggaacatatttctttaattctctcattagtgccaggggtagggattattaactctatttaacaaacgtagaaatcaaagttcagtagtgtattgctcaagatcacacagatagtacatagcagagcagggatttatgattccctcccttccctacgatgtctgttactctttctgcagttattggacgttgagacattgagcaggtcctatgactaaaggtcagtgttgggatccattagtgtagttcttatataccagcttttgttatcaattggcccatgggtgctgagaaaaatggaaattgatgggtttaattgagattagcccatgtcttgagtgagattatctctgacagagaaactaagagagtaaagagcctcgacagatcacattataggaatagtagaattctgttatgagcctttgtctttttagttcttataaaaaagtgaaaacatatttatgcaattcccattaagagttactgtggataggaacagacaaggacaacaaggcacagggagactaagggacttgcttggtcacacagctggtttttacttgaattggggctggaaacaagactttctgacttggagcccagttctgtatggaatcacattagttttcaaagccaagcctggtgcttattttctgggattgtatgactgacatcacaataagagcttgtctttgtgtcattactctttggtatcacaaccttagttcaaggcctgtcttattgcagttgccttctaacttgactttctgcttaaaatagtctcctcctctaatccattcctccacactgcagctagggagatctttaaagtgcctcttctgttatgcctttctccagtgaagaagcttgagctggcttcacggagccaggattgctgaatgttgccccaaggccttcctggtaggaacccagaggctggtttccctgggatgtccccacagtgtgctccatcaccagcagaagagtgccatcctggtatcagggtggtgtttctctgcgttctttatgctgccccacctgcactttgactgaaccccttggtgccccaatcccatgtctagaatcattttcaccctgccgcaggaggttcacatttcgctccctctttgaagcttcctgatccgtctcttaatcaccccctccaatggtttctctgaagtgttgttgtgttttgtttgcatgtctcataacactcatcattttccatcttgtattctcgttgtcttttccatgttttattccccctgccaagactgcaagttcctgaagggccgtaccatctagagttttgcatagaaataatgcactccatagcacttagcaggggaggtcaggcagtcaacggatattgtctggaataagggaaggagtgagttatagcatgtcagacatgctgttataataaattaatatgtcttgaatgaatgaacacatgaatgaatggctgtgataggcacttgacctcttacagacttgagaaaggggagtaagagtgaaagttttgaagtcattactgctgatcctctctcctcatggccactctgctcttctgaccatgagctgggtttggagctgcacacaaacagaggaaggctttagtaagaaaagctgtgtccccgccaggtttctgtctgccttgatcacagggatgcctgcaattggttttaaatggtggtggattacactgatgtctgtgactaagcacttgtctgaggttttccaagagcctcaccatcactcgtatccatcatttgacatgaagaggtttgtgtttgctctccagtctgacaagaaattgtccatcatttggctcaggagcagcaatctcccaccctagcagcctgctttcaggcccgactgtgcattgtgttaaaaactaagcacagctctctgacctggggattgaagaggaggctttgcagaaagcccttcttctccaatttgttcttttctgtttcgtgctggaacaagagaggtacagactgtcgctgtccagctgctgtgatatggagggttgtcgctcaattaggtgttggaggtgggtgggaggatttgctgggtatcagacagccaggaagtcaacacacatctcctggtgtgccccagaggcctggaaacatgcatgacactgaaggacacgtcaacgatgttcctctggggcagagaagagggcctaagcctgcggtgggcaagaccagtggctgccaaagggttttctgttggaattatgcaggaactaattcaactggagataccagctgctgaatgaggcaaagagtgaaggcccctttgaaggtttaaaaaattcttttccctcctctctgtgttatttcactggctacactttgcaaaggctaagccagatggagagaaaaggagcaaaatatttgaagtagttatctctccttcgcatcagctaggggcaacctgaacaggctatgcacttcttgtcatatttatattattattgataagttcgggaagcagactcagaagaacaatgggcctatttaaagcatcttggaatcacatcagctgatacaatagcaaccctatcccctcaactcctcccttcaaagatagggtggtgggtgtattaggcagagtcctttggtttacaagcaatagaaactgactcttgacaacttaagcaaatggaaagggatttattggagagcttagaagtgagaggagttgaataaggaggtgttgggaagatgaggatgtgaggcagttctggggctgtggtgtagtcgctcaggatgctgcctggcagaggcctggactcctcctttttcctcccctaggtcccactcttctcaagagtcagcgtatagggaaagagtgagaatggcctgacatggttatcagtttccctaagaccatgaagaatggaccaggggcagtttacgaaaggaaaagtacaattacgaagagaagggggggcactgggcaggaaaaataacagacttccaccagaatgggccaggtccactgcggatggctggctcatagtttcttccgtctttgtgaccagaggtattcattcattcactcatccattccacctattttaagcacctactatgttccagataatgtgctagatgctgaaaatacagtatttaatattccagttgtctgtgttataaacggtgcttcagaaacagaggagctggggagagtggcctgttttctccacagtgctgctccagtgagccccggggggatgccattcccaatgctagtaaatggaggatacgcatagaaggggatctaggcctttgactttcctccttcagaaagtttccatattttactatctagccttggttgcaattgcttctagtaattttttcctataagtatttatctacataatttgcagtatattacttccagttcatttatgttacttcagaagagttcttatatctttttcctgggcagttagttgtgttgtgatccctgtgaaatgtctaggcacccacggacacatgtaatgcttctacttttagtggtcttccctatcccccacttcctccttggagtgtctaataactacaagaaaacacagggttatggagcctatgtctgtgtgaatttggacatcctctgaaccttttcctgccttcattctctcatctgtcatacaaggtaatccctgccctgcctacctccttgtattgttgggaggatcaaatgaaataatgggtattaaaaggctttgaaaaattaaaagtgttcttaaaccccaagggcttaagattctatggctgaaggctagagggcttaacatgaggaatgatgactctatagtaaagataatagaaaaataacaatagtggtgcaacttatctggggtttattatactccaggcactatgcttggaatgcccacccagtagtggctgtaggagatactgatgctatctccatattacagatgaagaaactgaggctcagaaaagtaaaatagtttgcccaggggcttatggtttggtatatgcataagcctggattttaatgaatacatgtctactttatctctccaactagatgaatgaatgctgtccctgtctaactccctcatatttctcagatctgttagtgctagggttggaagctccacagcagatgtagggttaaaaatgtggaagctgaaattagacaacctcaacttcacatttgtctctgacacctcctagctgtgtgattgaagttgagttattcagtctctctgagcctcagattccttatgtgaaatggtggcaatagtagttccttattcataggtgtctttagcggaagtgcacatgcaaagttatagaaatagtaataataattactaatatttggttgaatgagtgattaaatttctaaactggggtccaggcaaagattatataaatctggccagcccaatgaaatgatagagattaaattcttaggaattttctctccccttcccccaacctcacaactgagaaaagtccacaaatgggtagcttcctaacttaatttggtcctcagatgcatttggcttggtcggcagaatattttttaagaatttgaatttgatgccaacatcatgaaatcaggcttcacattcaaatccatatatctggctgcttttataaaattggagaatgtataattatgggctcacatgcctgcccagcaatccccagctgttgctgagtatagctgctctctttacctggggatgcagcacttctgtgtgttcctgtaggcatttgagtttgaggcccctgcctgagaaacaccagagtcagcctaggaaacctaggggaggagatagaagtgactctttttaatcttaaaaaaagtctagtcctgaaattgtacctgttccccatttcatccaggacttgtcatcagcatttacttccacctattatactaagaagtagagagcagcacccgttgttgcagaccaaggaagggggagataaaagggaaaaccagagagagaaggacagaaatcatgctgtttcttaattaagctgggaaggagacaggggctgggagcggaatggcttgtggctcagcatttatcacacaactccccgctccacccggggcctgtgccggacaggagagccaagttgctcagaatggctttgctgatgtgccattgctggggtaagtggttattgatgaaggggcttaagtggtatgtgccctagagctcactcccagcctctgcagtttaccccatctccaggagctttgttgcacagtgctgacctccatgggtcctcttggcacccaagtcaaggaatcataccttcttcctcctgcccttctcacacacactgagctaggagttaggaagctggactgcctgtccaggctttctgactttagactctgatgcctctgctttaatggctttattactgatctgagaagtaggcaaatagcacattaatggcttttgtggataatagtgatttgggagatgtcacatcagcaaaattcaaaaaggatatgtggatccagaactttgaaagaaaaggaggggaaggttaaaaacaaacaaaaaagtagatgcagggagaaaagagatctttgcattttaaaagtattttgaatgcaatattaagcctcagaagattttagagatcatttctcccaatggttctctgccctggacttatattagaatttcctggccatctttaaagcaaatactgatgtctagcctttgcctccagagattctgaaataattggtatggggtagagaccaacactggcattttctaaaagttcctcaggtgattgtagtgtgcagtcaggttgaaaacactgatctaactttttcaccttatggtcaagataggtgatgttcagtggctttcacatggtcccaaagctggttaggcagaactaccactggaaatccaggttgccagttttcagcccaggtgtttattttacaccagatttccttgcaaatgctattctcgtatcattttcatgactattgccatatctttatatcatctgtactgttttaaaaaacaaatgtatttacatcaatttactctttaaacttgaatttatttgaaaagaaactatagtgccgcagtaagtagcagttcagcctcacctgccgtagatgggaggtaaccacaagaaaaattcaatgaaaagaaagcagcattgggctgagtttggtggctcatgcctgtagtcccagcacattgggaggccgaggtgggtggatcacgaggtcaggagattgagaccattttggctaacatggtgaaaacccatctctactaaaaatacaaaaaattagccgggcgtggtggcacgtgcctgtagtcccagctactcaagaggctgaggcaggagaatcgcttcccaggaggcagaggctgcagtgagctaagatcaaaccactgcactgcagcctgggtgacagagtgagactccatctcaaaaaaaaaaaaaaaaaaaaaaggaagaaagcagcgtcgttagattgtagctggacgctgttgcctgccaatgactctgctaaacatggagattggtaagtggtaggtgttccagatactagcaccaaactgagactccctcattgatgtaatcagaacaattaagagaaaattgaaaacggcactcttactatgtgattccatattatttaatgctcatatccttgtaccattagaattgtcctgagcacattactggtacagttttatttcccttaacaagtgatggtagtgcttatataataagcaaagtagtctaaaaaaaggtcagtatctacaaaatggaaaaatgaagtataaactcaggtcgttgaacaagagacttgagaaacttagagaatagagttagaaacatgaactaatcatgaacagcaccatagaaatcaattttcaaatcaggtgagaatcttaacatttatggttttggccaccattgatatatcgttgttagcagacttgtaggtagtgctctcagctaaagcaataagttgaatttagaggagctggaaactttaagaagtgtttcttgagattctgttttactctttcttttgagattccaggtatgatttggaagattcatggcaaataagcttctaactaaaggactcaaatattataacagtaaccagcattttaattctattttttgttattgaatttccactggaagagacatagttctatgttctttatttggttacacacacacacacacacacacacacacacacacacacacacactcttacagttgcaggatgagaatctgcccagataaagtactaacatactctcaggtacttataaaaattactatcctaggcctggaatctattctagattttggttgagcacattatttcagatttggtcataccttttccctctctccgtatctcactcccacccatgtggtagcattcattttccaaattgaaacacttgcttcatattccctttgatttttccaaagacattagagccaatagggagtcttagtcacccggtcaatgctatttgatacatttccctaaatgacatgttcttcttcatgtcgttgcatccacgcaataattaaatgtaccttcaaacactattgaaggtaggtagtctttgagcttattgcttaattagttcaggtttgtcctatagtttcccatcactgtgcaatcaatactactctagacaacattccaccaatattgggaaaagatgcctcctgcctccacgagtggatgcagcagagttcaaattgtgttgtaaattagtcgtatgggaaatatcaagtcagtcatactttcagagaacttaataagtgaatatacctcttcaaaacacactttatatacagaaaaaaaacccctacatacttccttgggacttattgttcctttcttctttcatgtcttcaggttagtagaaatttcaaccgaataaaagatacagctttttcaaggttcctgacaaagagaacccttatactattttaccaccttctgggccatcacagtaatttgattgaaatgaaaagctggtatttttctgacaagagacctactagagagctcaaagagtaagggctgagggagtcaggagcccccaagatggatatccagggcctcttaggtaaagtgtggcaggtggagcctggtgccaggggcggcagatcctgggacagctttgccctatgaggtaacaaagcagttcctcataggggagcagaccagaaggattcatagtttctaaccatttgttattttggatttcctcccaagataattctggttaaatcaagagtttcatacataggatgctgaatgggaatttgaccctttttagaccacaatatatatatatatatcttttgctttaaataccaacaggattatattctcggaatcaagggatcatggacactttattaaattatatttagctagggagttttccaaaaaaaagcaagctggacttgtgatggaaaaatttaagtaccgtgtaaagcaaaaagaattagactgtgaatgccttgtcaacagggatttttattttgttattaattcatctattcaacaaatatttatcaagtatcttcaaggtgccaagcactgtgctaggatctggatgtataacactaagtaaggcagactaaaaagttatggccctcaggtaatttaatcttgttaatctttatatcctcgttgcctgacacagtggctgacatgcaatagtccctcaataaatgactgttaacttgagtgtgaagtatgcccaagtgcatccttttcatctgtgtttttaagccttggtaaatctgcacctttgattgagccttactgtgcaaataatactattagtaacaactgtagcagctaatgtttatttaataaatgtcaaatgatttacattcattagctcattgtctcagggcatttatctatttgacctaggatttctaaagatatttttaggcatgtttaaaacctatctaccttttttacagagtttcaattagcgtgtagtttggtctagaccattgtaacttattttgaatccttttccccaaaccataatttgacaatgaaatcccattttaagcacatagtgggaacacaaacaagttctgattgagtgaactggatgcaattttaaaatgatattatcaggaggcttatctagctagatcatgagtcaagtctcagatctgtatgataatgatttgaagtcattagtcaatgctgttttgctatatgtgtccgctggacttttaattttttttttatttttagtaagattctatcagcactgttttgatgaaatatttaaaataaaacaatagtaattgttctacatcagtcagtgcagttctgcaaagtaactgtagcttcttgcgccattttgttaggagcttgtggattatatcatgtgcacaaccaacaacataaaacctttaaaaatacagaactcagggtacttgaatgtttataaagtattttaaaattaatttttaatgagttttaatattttaatattatactggattttaagtaagaaagttgttcttgtattaggcagtggtgtacaatattacttcatgggataatgtttaattaaaatacactaatttatgtgtttgtttattagctctatccctaaagcagagagaacctcttcacaattttatgaaaaatgtaaatgagggttttggcaccactaatacagttaaattagaataggtaaaaatgtatgcttctactttcataactttataaaaaagcaccttaaaatgttgatttgacatacaataaagatcactttccagtgaaaagattaaactcccatgaaaacaaccttctatttttctaatttccttttgactttattaggttttacctgatttgttcttgtctcaaaacattttcccttgtttcagtaattgttggagtcattttgatgcaaggatattatagtcagttttttttttttaacatttggaaatggttagctacccttgctgaatatggcccattttgagtattggtgtaacaaatgagaaacaccttattgaatagtatatattctttgctggttcctcttatccccaactaagattttatgttcctcaagatttgggcttggtttttgtaaacttttgcagtggttttaaatattcatcatgttttagaaattagcaattatattatagccttaaccttattatgaaacttactagtttctttttcctttttaaaataattgtttaaatcccttgatatagacaaggggaaaaaaatgagaaggcatgtcatactccagtttttcagagttttatttaagtgttctagataccagcacacaaacacctgctgtttttactgttctgggtgtcatagagacaccttcagtagcaacatgtttctagcagaaaataaaacagattcaaactacattcaaagggggaatgccatgagatattttctctccattcttcctttgttagttatttatattcacacatcttcacttaactacattccttagtaaacagcttgcggggggttgatatttgttaatgaactgtcaataaacacatgttctctcgacttcttaaaaaaagactatattggggttgagtgtgctggtttccaattcctgttcacgccatggagacagagagaggagtcttggctgcggatctggcctcagagctgggcacggcttgcgatcacgtggtggaagcacagcttttgtgcagggaggaaagtggcagattttgatagagagcgtgccagcagttattaggaagaaatcgggaagtgtttggaaacagggctgctagcattcccaacaaagctggagaagtctctccaaagaacaaaaggcaagcacacgttcagggtgaggactttcttctctgttgacatatgagacgtgaagtgagtcagacgctgacccaggtttggagagaggacaaataataatatctttgttgaaggaaatggggtctagtcattttcttttcttcctcctgttattattctttctttgccttctctttttctctctatggctgaacatctctactcaattgcctaatgaagtccttctgactataaaataccaacggagaagaacctcggtcatttgcaaacaaaaaacaaaaaacaaaacactcccagtgacttgtgggtagaggaaagcaatgatgctgcaagcagagagtgaacgcagggaaggggccagagaatgacctttgcattttgggcaccaacctaaagtacaaatgaataagagaaacttagaacagccttaaataaaactatttataatttgattagcgttattactgccttctcttcactttgaatcaaattatctcaagagcaacaattctggaaatttttgctttagaaaaagaaaaaaaaagttgaatttcccagtatccttgtctgctttttttttttccttaaaaatttcatgcattgttagggaagaaaagtctagtctaactcacaaatgcatccttattctcatgtatatttgataccggccccagtctaatctgataaagtgcactttgcctgtggtgtcttacaataagctggctgcattagtgccgggaaaaatcaataccgatttataatttaccatcgcaaaaacctatcactttttatgaccctccatcctggctcattaatattacattaaaacacacacacccactgcaacagggggaaattgtagcttgtcaggtttacagccataaagaaacctttaattgggcttagtttgggaattcaggcacagattttgtttatttgttttatttttaatgtatgatatttaccttaagtgaattttaagataatgtgtaatatacctatctatttctctgaaaagaaaggagaaaagcatgtcgcagaaattctgacatccactttcatatagatcttatacattttaatagtctctaatagcattcttctctgttttcctatagtctccaaacctttttcactttcttcttttttctctttgtgtgagtgtggatttctttatgctgaaacattccagctgatggtatttctcttatctttttggcttgtcatagttgatatttatccttcccacctcagatcaggaagaagctaaatgccaccttttgcattgtctgtctctcaaagaaaggatgcatatttgatttttcttctacaccgaatggagaatattacactgaccctgcttggaaactgagtgattctcctagtgcttgttctttcccaaaagagaactgtggactctctctctctgtgtgtgtgtgtgtgtgtgtgtgtgtgtgtgtgtgtgtatgtgtgtgtgtgtgtgtatcttcaattcttttaccttcaagaaacccccaaagaaaaatcaaacaatagtctttccttaatcaagcctattaagcagctttgccctcatatgtttttagacttaaaagtcttatatctaaattctttccagataatgtaaaaaaaaaaaatgatgtcactgtttatgttggcagcggcaaggtgctctatttatttcatactattcaaatagtttccagggaatttttcctgtaaaaatcatgaacagaacttaccacatggcttgcccctttcccttgctgccttaaaggttaaggcttctgccccttccaaccttaaaaagaggcaaaatgaagtgtaaagcagatccaaaaaaataaataaataagggaagggggaaattcagtgtgttctcaagtgtgcagtagttccacaccatgcagcaaatacatgtcgtgattgggtttttaaaagacatccgcctggcccctgactgacagggcctattgattttttaggtttctgccgtcatcggtttccagcctcacagcggccgcatgtcgggggtcagggcgcaccggggcgcagtgagccagccctcgccacttcccaaagtgaagggccgctgaaagaaaatcaatcatgtcataagtgagaagcatcaaaaattttccccctgtatggccaaggcccatcagcctgtctccactcagtagctaaggttaggcatctgtcaagtcaagactaggtgaaaagtattagaaatgccagtttacccacgggtagaccgtgtgggtgtgaggcagcctcttccctttgtctggccatcccgggatgacagggttggcgttttcacttaatttttgagtcagaatcacccattttcccttcctttagcctttgtgtgtgtgtatgtctctttctctctcctccctcctcctaaggcagggcgggttgaggcctggtaccctgtttatttaagaaccagtgaaaagtcaaagtggatgcattcccaggcagcccactgggaggtcagcgccatggcattcttactaagtcacagagtatatttccctaaatgaagcagatttttaaccacccctttcatatcttgctgtggaaacgcacatgacacagataagtttaattgtgaaattaatagtgcatatcccatggtagaaattttatttggctactgtgctgatgtttctgaactgataggatgctaaattttcttcctgtgctactaattgggagaacgtatatttttaattctcagagaaatgatcaggaatattctgttcatttttaaacacctttttatatttcttacattccaaatccatgtcatgagattgcatagtttgttgaaagaaaccgtattaagtgtctaacttaaagaaaccctttacgtgtactttctaattgtgagtttagtatttagtttccaagctataaatcatagattatgtattctgtgagagaatgataggtttttattaatgtattttagattacattatttttaaatcaataaggttcaaatgaatagttttgcttgcttgtctgttttgagggataagaagggtggattggggaactggctgtcaggcgggcctcactttgtggtttgcatctactcagctctgcctcctttcaagtgtgttggttcactctggttccatgatagtcgctgtccatttaagaccagtttgaaatttcccaacaagagcttcttactggaaaatctgcaggaggagttcatttgggtgtaggggcagattctgagatttccttctgtgcatgggatgactaccccaggagcagtagaagaacctgaaaatgaattgaactgagagctctgctgtaactttccaccctaaattgacattcactgcctgaaccaagatgtatactcactaataaatattttagctctctatgcctcagtgattacactggccattccatacagataaaaatacaaaatgtttctttaatcagtactgtgatgtgagaccgttaaggtaatagtgcttgaaactattagaatctcaaagatattgactggcttgcttttggcatggcaattataattacatttttaggttacattttatgggtttatactagttattctaacataaaagaaattgctgtccagaattttaacagagggcagaatgatctaggttgaaatccttagcagtcccagcatcagggctgctaatatatgatctaattgtgatcaatactttcttttctagtttctgtaatgacaaggcctttgcaataaaaacactaccatctttttgaaatccacagaatgataaatgacctaggccaacttgggggtgggggtggggaagtgtagtgtattttacattcctagtgatttattgtgggtttgcacacataactggtgtgaaatcaagctggaggggggttgaggggaggaggaaaagtacccaacaaagaaatccattctgcctaaaatgcctaggtttaagtcccattaccattgatgtgagctaagtactctcatcaagaggcttgggagcccttgagttatttagattctttttgtaacattacaggagaggggaaaaaagccaacacaatgaatcactactttgctatgtatgaatggctaggtcagcctaactcatgtgttacataaaaaggaccaatttcattctgtcttgacaataaatgaaagcttggctttgaaggtactctttgctggatctatttgcttttggagacagtctattggacaggctctgggaggcaggttatttcaggtgcaagaaaggaaatcacctcgtttcattaactattagggacttaacttcctttggtgtaaagctgagtccaatcatcccagatctccaatgagaggatgggggcgtgcttgctgtcctaatcaaacccagctggtcattcggtcccaacaggtaaagtttttgaggaagccaagtagagatttgtgaattctacaatataaaaatgtgaaaaatgtgtcaatgtgagccccttccagctctgaccccccagttgtttatgtccaacagtgtttctcatgtggctgtggataagtttctccctctttccattttaaacttccatttgtaggttgcttgtgacattttgcttcaggccagcacttagcatataatattacagatgcctgaaatctttcagcctttctttttcttttcttttcttcctttcactctcactctttttttcctgcctctctctgtctttcatttcactcccaactccttttttccttacaacaccaaaaactctttcgtttaaaaaagttggaaaatatatgaagacaccacacagcattcacaactttagcactgatctgatctatttttctgctattcaacagacctggattttttccctgtgaaccagaaagtcttttgttttcttgtctcagtaaacacagcatacggtatgtactaagtattaggactcaggggtcttattcaaatattttttggggggagtggggtcaggactatggaaagagatacaggaggtgtaggagactgggttttaatgtgagatcattaatcatttcttttttcctgaatcaggcttgggacaaaagggataaagagggttttcccctcaaatattcaatttatcctatcagatttcccacagtgactttctctaccaaggttcttaatgcactactcttagaatgtctcatcagtgaccagagctgatggggtctttgaacattagacagtacccattagtcaaggtccctgggctaacatctctggatggcattttcttctaagtgtgccattagttagtataatggactggtgtctgtcagcctttggggcaggacagagaggtgcatcgaagaccctttgttagaagatgggctgtgttttttcttcaacctgcaagcatgtccccagcaacgtttttagcttttgaaagacaataaatgttaatagcttcagtgaagtctttataatctcccaggtcagaaattgttgctgttttttctccttaaagtctcaaatatggatttacaaaatactctttggaaccattatagtcttttgggtaaatagttttcattttaaaacatttttataatacacacattttaaaaaatgttctaaatatgtatttttacgattgatcatgacagcgccttaaagagccattattgcctatcagggagataatgtgtgtgtgtattcaagaaattgtctacaaaaagaaaactccatctcgaagccgtgtatgtttccaatgaggatttttttctcaccaataaacttgaaaaaattatgcaaaacaattgaaatttagacagatcatccaagtgagacagttcagagttgaggatttttgcaatgcctctcaagtggcaactgagaaatttcaggattgaaagctcagaaacactggctaccttccttgaggctgtgaacataggttaccaaaggtttaggtaattttccagactttctgcctcaagcctgaagtttttaaaaagagaaggctctgattatattgggttctctgaaccacaggttgccatccaatcatggagggctagaaatcagtctgaatagggcaactacttgttggtttattcaaacgtactgactgtatcattgtgctaggaattagagatattaagaggatgagctgcatctatgcccttggggagcatgcagacctacaaacacgttcactgtggcaaatctacaatggaggcatgaatgaatcgaaacaccagcaaaatgatttaggaataagaacggaactgctgttcataagatctaggtgtctgtgcatttcctcagggtacaaggtggtggcaaaagactgagggagctggcccaggtggggagaggtggtgagaaccagaagatggcatgcaggtgataacaacaatgacaatgaccacagctgctactaccactactactactaggaattattgaggattttatgggacatttagctaagaatagaatatgaattaatttttaccacggaagataaatgtttgcctcattcaaccaagaaatatttattgcatgccttctgtgtgctagttacttgggggtataatgataatagggtcctgctcccatggaacttatagttactgagattgggggttctggagctcagacattaaatttaaaattcacacacctgaatgtgaaatctgtaatgtgataagtttacaaaagggaggacgccaaatatctggctgatttgctggtcctatctaatgaaggcagcaggtgtgtgtgtgtgtgtgtgtgttggtttgagctggttaggaaggtgagggaaacctctgagaaagtggtgaaagaagaatggaagtcatgtaggtgaaggggtgggattggggtaggagagtgtgaagaatgttctagagagggaaataggggatgaagagagaaaaggctagaaagaggagaaataaaaaggtgcatcaagagggtggaaatatccttccctctcctccccttcccttctttcaacaagtatttactgagtacctttcaagatccaggcactgatcttagcaatggggattagcacaaataaaagagtgaaaaaatccctgccctcatggagcttacgttctagggcagggagacagacaatcaacacacaaaccagtaaaatatccagtacgtcaaatggtgatgaattctgcaaggaaaatagtttgggaaatagggtgaagaaatatttggggaggggctgaagttgtcattttaaatacagtaactagaaaaagcctcactgataggttggcttttgagccaagacctgaaggagcagagggacagagccttgcggatagctaggggaagcaaacacagggcaggaaaggcagtgtgaggccctgcagggagtgtgcctgacaggtttgaggaaggctatggaggccagtggggaggagcagaacgtgcatgcaagaaagtagcaggtggcgctgcccaaggcatcctggggccatttcttgggccccgtgggcgctatggaggtcctgggcttttactctgagtgagatcggaagccatcgaaagtggaggacaaatagatgagaagaaggtttccaagcaatgaagaagatatccacctagtcattagcgttaagccaagaagccttaaactaaagggaagcgtttccaacaacaggctttgggtattccaggtcatctgacatttcctgagtgaaaccttaagaccactacaactagtgatttgatgtttttagaatggcttctgggtcagttccactaacaggatggctaagccgatcatgattcataaagatgcattttgggaacagatccattgtacttattaaacatctatccgctttgacaaccctattgcaaactcagtttccacgaaaccatctatgtttatgtgacaactgtgtacctaaatatacgagacagtacgtgggtaatatgggcaggtgactgaaataaagtcagctgagggctgagtgacagggcatccagctgggtagatggaagagcagggagggaaaaagagcagctggggacacagattgaggtgggcaggaaagacaatggcctgtcaggatgagcaccttcccacaaaggtcatcagcccttcatggacaatcagcacggacaccttggcttttgtgtaagctgaagtttcattctctagagaacccagtgtgttctccaaaaggaaggttaaaattcattgtggcaatttgcaaaatgatgaagaggaagaaatagtttattattcacattcaaatgctttgttacccatacatgagtgtccttcttctggttccctttctagcattagggctatagtctttggtatgaatctttaatattaatctctgaacactaagaagcaatttcaatgttatggactttaggtcctcggcacttttccagggtggaggtgagggagagcactccctaggcttagctcttgaagacagtgctggatgggcgtgttggttctgtgggctttttagaggccacagtaaaaatcttcttatatttagacctcttcatgctttgggactgcttgtgatgtttttcctgtggtcttttggtcatctccttgacaatttcctcctatggcatttattctagaaaacagaggttctcagtatcttggggcaaacactctgatttttagtgaaaagtcatggaacctcttcagccttgacctgggcgggaggtgtcctgcaaccgaagcaaaagcaaccacgactccaagaaggcagtcccctgacagcctgtactgctgggtccagggccttgatgccgggaagttatttcgtttatgtttgcctgtttaaagtccccatttgcttttcttcaaggtccagcttccaagtctagttgactttttaccatcactcactgggctggccacacagtgccggaattcatgggcctccctggacaggctattttccgagacccatggaaatcagatcaatgctcgctcgctctgtgactttcatcatccacgtgctttctaaatatgaactcattcttcttgcaagaatcaggttaagcattgttatccccactttacagatgggcgtgcccagatttcattattccgaagatagattttgagtccatgataaatgtacttagcattatagtaaattgaagatgaaaaggcctaataggttacccggtattgcccctccctcttcacctccatgctaccagaagctcctgcaatctactttctagtgctttgaccagtcttggtttaaatgtcccaggggaacctccctgtaaggctaaacttggagaaagaatctccttctaaaagctacttttgtggtctcagtgctatgactcctcctccctacagctgaaaggcacttggaagtgagaggaatatggttggaagtcttttttcctttctcttttaggagaattacaaattccaagagtcacatgtgtatcttttccttttatagtagatttttatatgcctttctaggtttactaacagacatacaggattttgagttacagttgggacatgagctcatgaaattagtcttaactgctttaacccgtaggtgcttgtgtttatggaataagaaagtcataatcgctgaccgcagccattaaaatctgatgtgagtcaactttgagtacaaaggctttctataagccaaccctcttgaagcagaaatgatcacaatgtaatataatgagaataattaataaggagtgtgccagtgaccttgaatattaatattgtttccttttcctgtaaacaaactgggttattttattattattttagtgtgtaatttggcataaacactccttttcacatgatttccccaggtgacttttgtctccttggcaatttccggctttaataaagaaaacctaattaagaaggagctgttgattggtttgctagtgtaattaacacaggtgatgctaatgagtttctatgaaaccggtggtttatgggaaaaataaacagaccgttgttgcatatggcccaactgatatctgcactctggaagaaatgatgatttccaagtctcctgtgagtggtttgtgggcatggaataggcagataaaatattttataagattcattagtggaacttgaccaaattgagagcaaaaaaagtctcagtgttaggtgatattaaaaaatctgatccctggctgtagtacgggttaggtttgtcatttttcatgtgcctaaaaaggggcagatttcttttgtttggggtgtgtttccaattttcattataggcatttgaagtttgcaaaacttccagcagcctttttttttttcttctttctttctttctttctttctttctttctttctttctttctttctttctttctttctttctctttctttcttttctgtctttctttcctttctttctctctctctctttcttctttttctctttctttctttccagagtctcactctatcacccaagctcgaatgcagtggcacgattacagctcactgcaggcttaacctccagggctcaagtgatcctcccacctcagccactggagtagctgggactacaggtgcctgccaccatgttcaactaatttttgcttttttttttttttttttgtagagatggggtttcaccatgttgcctaggctgatctcaaactcctgggctcaagtgatcctcctgcctcggcctcccagagtgctgggattataggcatgagccacagcccccggcccctagcagtctttctagggacattttaatttttattcttttctccttgactttgcccattgacccttgaggatgctgtgaccaggaaggcacatgggattgctgcagaaattaagattcctgaaagtctcttttcttagcctacaaatgcttcctgaggagcacttcttttgggttggggggaccgagtcttgctctgttgcccaaggctggagcacagtggtgcaattttggcttactgaaacctctgccccccaggttcaagtgagtctcatgcctcaacctcctgtgtagctgagattacaggtgcacaccaccatgctgggctaatttttgtatgtttagtagagatggggttttaccatgttgtccaggctggtctcgaactcctgacctcaagtgatctgcctgcctcaacctcccaaagtgctgggattacaggcgtgagcaaccgtgctcagccaatcctgagaaactcttgatatttgtattttcagtggtatccaggctaggttggtacatccagaattacttacaagaagcaaatttcctttctttttttcttactttttctgggctgggaggggtgctagggacttcagatgtcatttcacaactttatacaaggaacaagatttttgtggcatcaatgcatattttctcattgtaaattttacttggaatacatagctattagtgttgataatttacaaataccctgttcaatttcaaaaatgatttttgaagttgttttcataaaagacaagttgatcataagtcctttgatgtttacacagcattttgaggccccttctctttttcagtggtatgttcttcccaaatcaattttttaagtatgtgttttgtcttcatttttatctgatatttcatcagcagcaagttaattctttctcttttttcctgtctccaaaaatgcctgttccactttgtctctcatctattgctatgtgacagaaaaacaagagacattctgtgtctagcagtgcacctccagggacatcttttgaactctcataatttgtatttattgccacccactttgtaagttcacagtttaatttgccggcagtggcagtgttaggccgacacagtaaaacaagataacgttaaaatgtcagaatgagagggggcatgaatgatgcattacccctaccaggacttgcacttgtcattcctttccaccaaagtgatgttaactaccttttgagagctttatctgactggtattactcagaaataggatcattagttcactgttctgattaggaagccgctatgcttgattaactcttcttggactgggatctcagtggaagcattaaatgaatcgcactgacttagacatctagaactaatttataatttttttttgcaattatttgtagttgttgacatgtgtttttccatgatgtggtacttaacgggaatgagttaaacctactggagacaagcatgtttgagttgcatattttaacccacatttcaagacaggtcttctagatttacaaaatgtttcctgtggacagatactaagccattgttctcaatagcatctatgtgtaattcattcacaactttttgaaatttctgagtttgggaaatttcagcccttttgtagttttggctgaatcatttgccctagggggaaactagttgaatttcatgtttactcacagtggtgacttcatgggtgttcagaagcagggctaacatgtgccttaaagaaacttccaaagtgataaatctagaatattgaaacaggaaatccctccccacttccccattccccaaaaccacctcacgcagttctttccctctctaaaattttcttcgtaatcctgctgctgtctgaaatcctaccatattgattctttggcttctgagcaactacataactctctgccctcttccaaacatatactcgatacgtatatggatgagttttagattatctcaagagccagttttgatagggaaagcattgaaaggctggaaggtgggtatgggagtagcactaaagagaaactttatcctacaacaagcatcttgatggtaataaagacgtcttttgtgttccatagaaaagggctccattttacggtaaagatacatattgattctggtccatagttccagaatgaaacttgtattttagtttagcctttccaaaataagaatatttttcaccttataattcaaaacagaaacagagctgtatgaaatcatctgagggggatttgtatctctcctgcactactgcatgtacagtgcccagcactcctgggagctccctgtgcatttgttaaatggaagggatgaagttatcactatggagcagccttccccaccccccttataagtacattcccccaaatctcttatttcctgaaaaggtttttttatctgtgtagatccagaaacttgggttgttattacagatgcctctgatgaacctggggttaccctgagcatattaacagcaccatcccattatgttcctttatcatatacttgacatctgccctaaattactatccttcactatctgcttaagtaagcctatgttctctttggagatttcttggcagctaacccttggctgtagatacagatgaattggccttcagctatttgtattaaaaatataatcaggacttgcttgtctaaaaaggtgatttggacctggttttcagtaccaagccaggtggctgtctttcggggggacaagtttaactgagatgggggaagctggatagcagtgtaagaattcaaaaaggaacttgctttcagggtagttacgataaagccctaggaggtacaggaaaaagaatatgtgtttggtttgagtttcttgggtctattaattgccttctaagagtgtactttttgtcagggtgaatcatttatcgccaattccagtttattgatatttctctctgtgagcctatttttcagtggttttgccatctattgcccagagaattgatgctgtctgagatttgactgtaatgctgcttttgtagagaggggaaatgaaggcatagaaaaataaatagctttttataaccctatgtgannnnnnnnnnnnnnnnnnnntgaaaaagtgatcatcaaattgggaaggactttttctttttctccttccatacctgtgtggcagaaccttttggtcaatatgggtcaggcttaatcaaaattaactttattttaaaaccgctgttacttggaagttccctttctatactctttcttagaagggaaagttgggtgtgaagttctaaaagaaaagctctttggacaagaaaatataaaacattttcccaagagtcacaaataccagtgtgtgttttagggaagcaaccaatgttacttcttctagaaataattggtgtaactgaattaagattactttcccaaatcagatcctctgccttactcaaggtttcctgtgttctaccttgtcccagatagagaacaaaatgaaaccctcaccaattttgtctaccttttttgctctaagccaaggttttgcagcaccattaggatgtagattatcatatttaaaacctgtgatgacaccgttgtacccatctgaatgattaatctgctcattaaaagagtgccgatgggctagtctaattggaacatggatcttcttaaaggacgttacagggtcgggaataggaaatattactcataacataaagtagggattaattatgctactaaatactactatgtgaaatttacatatgggtctggttagagacaaggattagaaaaagtgtagcatcccattttataacatttatgtcaactttaagacaggtggtgtgttccttctttaatcccaaatcttaaatcaacatttacaaaagctgttataaactcaaatgccacagaaggcttagaggttgggataaatgcagaatttgcataagtgaatcaccgtgatttaactgtatggattttcaaaaacaattgcaaagatccaaagctgcagagcagtctctactctctgttaaagcttaaacttctgcatgatattaatcttcctaggaatgaaagtacaattgggatctttcagaaaataggcaaatccactgagcacaagtttgcaagcattttttttcccaaataacctttctttaaacaaacaatatgtataaaagatgtaaggggactgctcaaagcaaaggggatgggagatttgaatctccacctaagagcttttatgccacatggatcctgtggccacacagttagaaaaccaccgtataatatggaggtggatcctagaatctgggttgaaaagaaccttgaagctcttttattctatctcccttattcccaggcaagggagcacaaaacttacataacgagttagtgacaaccagagctaaaaagtaaagtttttgactcatagttcagggccattttcaacaaacaacacgatatctctagtctggttaccaaatatctcaacacgttggattatttgtttgacgcatcacatgttaagctatctctgtttactgaagtcagatctgtttgacaaatgtgaaatatattcttacacatcttgatgatttgttgcatttccactacttgaaaattcatattatttttttacttgtaggcagatgtcagatcatgtgtcaagtaaaaaatggaaagttgctcctctggagtaaacactgtaccaagagaaatgaaaattagagcacttggttatacgtgggcctctacctgtttaaggaactcaaaggattacatattggtgttttgggtccttccaagctcagctcagagaatttccctgggctttggtgatcatataatatttctgggattggggaagccttaggtagagaatactgtgcttacagagaccctaacagactgtcattatcaattcgagcttctccatacctgtgggtccttctaaccagctcccatgtttgttctctcctttccattttattctgcttgtctgactgagttgaattcaccattatctctcatccagattactagagtaacttcttagctatctcctggcctccagtcttaaccctactcggtttgctgtctacacggcagctagaatgatctttctgatgcttctgacatcactcttctgctttaaagtggctcccacttggacagcctggctcctcattgtcccagagatgaaagtgcaagcttttaagagttatgtacagtgtccttcctggcttcatttcttgctactcccctccttacattggaccactttgcactgatgcacactcaccgtgaactctgagcttgcttttgtctttgcacctgttttcccctataactggtatactcttcttagctttctccttgcctcagctttcatctggctgtgtctgacttatccttaggattaaattcagcattaacttctcaaaggggccttcttggacccatcaacttagggtacaagtgtgcactctttctccgtcatagcatttttcacactgcctggtaacagtttaccatgtaactccccccatccccagcagcgagctccttgagggcagggtgcaggatattattgtcttcctatttttgtttccaagtactatgtctgattccaagaatgaaatcaataaatgtgggaggaaggaaacaaagcaataaacctcaacaagaatttacactagaaattgtgcagagaaaatgttccaacactctttcgttagatattccattatatactgccattcattaatagctggatgggtgcctttttatgtcatgtttaaatgtttcgatttaatatctttgtttttttcctacccaagttacaaaggggatcaggtgaccaccagcttccctagtagcacctttaaaagcacaggatccctggggtcgttctatttgtgattctacattgcatgctttgtgatatgttttgtgtgtaggcagaggcctataactggtagaagaggtaggaaagttgttttttcagttggagggagaagcctttgtcatggacttcggagtattctctaagcttgaattgtggcatgtcgtaggggtcagttctgaagatgttcttactgtcatccaatgtaggagatgaaaccttcaaagaacctgtactgtcattccgtaaaagttaatagcaaagtatcattgcaaatctgttggaaaatgtttgttttttttgtggtaaacctctgaacatttttaagactctagtgtgtagagaacctttctttagaaattcagatctggtgggataccataattggctagtggtggaacagacatttgaggatagtattctttagtgaatatcattcattcctggacctccacagtctgtaagtgaaaatataagctataagccaccgaagaagttaaggagatacgtgattgtagtaaaaccttgactggccagaatgccagggaaatggagtgatctgttatgctttttcagctttgctggtggaaaaggatttcatcatcttttttggtaaatagtggtctgtctatagggcagtgttataggaggtacaggaggttgggctagatgtgaactcactctggggtgtcactgagttgttttcctaaattttagaattgtgggccttttgagtcagtatgaaacttacccacgatctgataaaaccccatccttaaagaagtggaaagggaggctgcagagatggctcgaagtcctatacctttttagtcccgcaggcgagatttataccttgctctcagacttctaatatactgttcttcaccctgaactgtaagtacctatatgggctttgtaggctttaaaaagtatttactttcattctcttataagcccagtacagaaagcaatgctagttaactgaggaaagtgaatagaacataagaagttgtactctgataaaacaaagctttctataatgacactctggtttatagcactgagaaacttcatgattctagaaactcttcctagggaatgtgcagagtcaaagttgcaaactggcaactgtgatcatattgagcttggggaagcgtttcgtttggccattgtggtgttgttgccttgtagatggggtatatggtcctctgcttgcctcggtccccagcctcttggcagcttcacttcattatgttattggcttggtttccaaggcttttgaattggaagctctgagtttaatgtgattgtttgttttgtttggggcctacaggaaggtaagcaagagatgcctattttattttcaaaacatctgagaagggggctacatttatgggatgggctagttgttgacaatgttgtttacgtattttggaagcataccgcccctcaagctgccaccggctttatcagatcacttaaacacagtcctgtgctgccatcgatagcagtccaaatctgtgacaattggtaaccttcagcgtttgtatggaaagatggttgatcggcctgtgcatcggcacagatgcaaggtgtaaacaaatggggttgatgcatttgtgccactaaccactcaggtttatacaaaaagtatcaagctttccctgtttcatctggaataagactttctaggatttcaaaatttcatttttctctcttcctaaaaaaattcgctctctttccctcagaagcttagataaagaaataattattgagaaaatagaaatgacctccactggtcggagttttacttagtggtaggtggtaagcacataatttatctcttgttcctaaaatgatttttattttttagaaaataaattaaaagagtaacttacattctctgtagagaatttaaaagaatacagactggaaagaaaaaattatcttttatccaaaaatttggaaaaatcatctttttaacatctgtattttttttcagaatattttctctgtatatatcagaactgtgtatttacaaaattggattatgctgttttgtgacctgcttttttcttttattgtgaatattatagtgtatctcataattttttaaacacatagttgcacagcgttacatcctatggctataagttatttactctgttgtagagtctgtagtcagttttcaattttttgcaattgttaaaatcagcaatgagccaccttgtgtatctttgggttgaatatgatttttttttttcctttaagcttaattcctcaaagtgtaatctttgaattgaaggagatgatcatttttaagccttctgatatatgtggctaaattgccctccaaaaaggttatactgtttacactttcactatgtgttaagacagtgcagttcactggcgtcctcaaaggacctcatttagaaacttgtaccaacttggtaaactgaaatatagtatttatattttgtgattattgctgaggttgaatactgagctcgaatatttttctttgtgtttttggccatttatatgcatattttggtgaattgcctattcattttctcccttatttttttcccttatgggcttttatttaggtttcaaaaaataaacatttattgtctcacaagaatttcaggtcagatgtagcaatctgaaggctcgactggggctgggagatctgtttccaaggtagttcgttcacagggctattggcctgaggcctcagtttcttgatacaaggcctttccggggctgattgggtatcctgatgacatggcagccagcttctcccacactgagtgagcctacagagagcaaacaggaaactgacaggcctttttgacctagtcttggaagtcacacattgcactttttgtcttcttctatttgttaagagcaagtcactaactctagcccacattcaggagagagaaacgaagttccacctcttgaagaatttgtggatatatttaaaaaccattagagaacctattttttaaaaacatttttcaaacattttcctccagtttgcccttcaatttaaatttttttttacagagatgtacaattttaatatacttaagtctattaatcatttccagttttagagtctttcttttgctttgtgcttaacaatgtcttctttactctagggtcagataaatcttcacctatattttcttttagttctttgttgatttcactttttacatgtaacctctttagtgtttctataatttatttttagaaataaattagatacagcaatttttttctgaataacatttatttaagtggcaatttttgaataagctcactttctcttaatgatttagaatgcctcatttattatcagtaaatatagggtagatattccactgatacttacaatatgactatagcccttattaaaatcttaaaatgcttccatgctgattggtaaatatctgctgctctaagtgtcccctcctttccttccccctcagttcagacccttctctatcaatttaaaggggcttctctggtgcatttaaaggagtgagtgtggtattatgtcttccagactggagctccagggacaatgtaggtgtcaattctgctattttgaatagccaccctaactagggatatataggcacatggctttctgttctgttccattgattggtcgatctagtttgattctcttactgcatgattttaattgctatggctgtataatgtgttttaattatataatcatcccccattttcatgactattattgcttatttattcttgtatatgaatgaatcatatttttggttaaaataatgtctttagaaagttgagtaatgtattaaagactagggaagttgacatctctactaaattgagtctttctatcttgaaagtatatatatatatacatacatatatattcttttgtcttaaaagtcttcctattttgaaagaattatatattatttatgtctttaaaattcttgaccaggcctggtggctcaggccggtaatcccagcactttgggaggccgaggcagacagattgcctgaggtcaggagattcagacaagcttggtcaacatggtgaaaccccatctctactaaaaatacaaaaatcttccaggtgtggtggcacactcctgtaatcccagctactcaggaggctgaggcagaagaatctcttgaacgctggagacagaggttgcagtgagctgagatcaagccactgcactccaactagggtgacagagtaagactccgtctcaaaaaaaaaaaaaaaaattcttaagtagagctagagtttttctttatatttttgttttagtttatttcgatttgttttatgtttggcatctttttttggtgttaggaatagtatattttctaaaatatgggcaaatggttattacaattatttattcctcagatatgttaatggttcaggggttctttaagaaagttattttccaagctttggaaaatgcaaattcactgaagtcctttaaataatccctcctctcactagaattttgaattaccttgatatgatgcacaaaaattctggtcacttacattgtttaagtagccagttcaagatgacttggggacaacttgagtaatgtgcgaatcgtgtgggcaatcacatattcctgatatccaaaataccagccttttcattttctttttctgaatgtttctgcttgaaattacccatggtttaaaatatgcacggcacatggcattgaacgtgggaagtgttgttaagttttgaatgggatggttagaaaacggcgtttctggttgtgtaagagtctctcatctggatctgaagcctcttccggggaattccaggccttctcccctctatgtcataaaaatgactgggtgacttcgcaaagcaataataccagtgggatgtgtatattaacctgtctgtggggggaaaatgctgagagcaacaggcctataatttaggtaatagcgatagcctatgaaaaacatgctgcttttgccttgatgctaatcaggaaaccatcagacagtcttccctgactgagtaagggcagggcgggaaggaagtcagctgtcatcatgtttttgaagaagaaaaaaatgagaggtgaactgaactctgtgatcggaacctcactctaaggccgcttcctgaatttaaaggtgtggtactccaatcagcaccgcaaattggaggcatctgatttgcatggattaacaggagtgggtcacaaccttctgacaggtcaatggcaccactggggatttgaagaaaactttgattctccctcttttccccctctgccatgaagcaatcatgctgttctattgtaaaagaggatcccttacttataaagccaagcttgtcatttaaattcactcaagttaggacaccaccgagctctgtcagatgtcagtctcaattcagcaggagaatgtttttcaacagctttctaacctctttgccgggaaacacagaggcttggatcaagggggaggggcagctgactgggcttgaaggatttttacagaggcaagattggaatttttcatttcaggcaggttttctttttctttacgttttcttattattattttttcctttttccctctaagcctcgtgtaaaagatattcccacaaaaagagagtgaaaaaaagtcagattggttgtaaggaccacttcagttgagggtctccttgaaggtatttaaacctgggagtgatgttggcatcttttctgcattaggggtattggctgtttgccaatcatttcccttgaaaaatatcatgcggccataaaggaactatgaaatgtttggcagaggaagcgtccatggcagaatagggacaaagggaaatggagattttctgattcagcctctggtgccagacccaaataaaaagaagaggcacatgccatggaactatggcttacctgaaacaccctgggtcaaggagctttgaaatggtagtggcagagttgggaccatttttttcttgaaccttgattaaccaagtgctctggagataaaatgttcagagagttctaatatactcacttgctacgtattgttttctacatttagctacaactgttgattcagcatctcctataggccagatattatgccagacctaatttgcaacaaaacagatttggttcctgccctcttgggacttcctgcttagacctgcctcatcaattttcatttcttatgtgacttaatctttgtcatttaaattccagtattttcttgcatccatgacagtgcttaccattgtattaataataccttacagaaaagtctggtaaatatctataattttattggctgttcaagtaatgtttaaatttatgaagcctcagttttctcatctgtaaaatggggataataatgtctatctcacagggcgcttgtgaagagtgaatggtataatgtatagaaagcactcagcagagagcttggcacagagttcttagtaattgggagctgctagcatttttcattagaagtgtggctcacgcctgtaatcccagcactttgggaggcctagacaggtggatcacagggtcaggagatcgagaccatcttggctaacacggtgaaacccggtctctactaaaaatacaaaaaattagctgggcgtggtggcaggcgcctgtagtcccagctactccggaggctgaggcaggagaatggtgtgaacccgggaggtggagtttgcagtgagcccagatcgcgccactgcactccagcctgggcgacagagcgagactccatctcaaaaaaaaaaaaaaaaaaaaaaagaagtgttggtggcagaggtagtgggagtggtagtacatgcttaacatctagaaccttctcttctggttaattccattggaacctttctataatattttcaatattttcaacttcttttttcttttagtaagtatgtctttctcaaagaattaattgtttggatggttgaagataacttggaagaccttaaggtcgtgatttcatgatttgaaacaaattgtcaagagctattttagaaggaatatctgaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgccatttattagctttgtgaccttgggcaaatttctaaatctgaaagacacacacacacacacacacacacacacacacacacacacacacacacatttatatttatttaattaatgcagtatctggcatattcaagcaggagcttgtaacaaataagtaacaactgtaagaaataagtatttgttgcataaacaaagcaatggcctgcaggtactcctcctttggtaagccattgctaagcaactctttgctactcttcctttcagctgctggctgaacctgcagcatcttcttgtgactcccctcaatggtagcacacttctactctttgaggtttgatctgagtttcggaaacagccagcagtaatttgataacgaggctggtgtaaaacatcagtcgattaaagatcattttagatcagaaatgatgcgtccctgtaagggaactactatattgagatgaactcaaaacattctgcctggatttcaaagaagagctgcaaatgctctcaagcagtcttccaaagtgacaattaagaatgggatggaattcattttgatgtccagctctggtctaaaagtcagtcacattccaggtctcactctggcccctgtgctctggaaagagaggagcagtgagatatggccattgttgatatgaaaagcagaaggtggaggtcccaggctgctgagttagccctcagtttgaatcctgcgtctgctgttttttagctctaagtcctgaggcctctaatatacatctactctgcaattacttctctctctctctcttttttttttagatggagtttcgctcttgttgcccattctggagtgcagtggtgcaatctcggctcactacaacccctgcctcccggattcaagcgattctcttgcctcagactcccaagtagctgggattacaggtgcccgccaccactcccggctgatttttgtatttttagtagagatggggtttcaccatgttggccaggctggtcttgaactcctgacctcgtgatccgccctcctcggcctcccaaagtgctgggattacaggcgtgagccactgcgcccggcccaattacttctctgtaatttttttcccctgaggattggtggggaaaaaaaatgcttggcacataacacccatgttaagtttcaggattatttcttctttttacattattttagttttttgttcatatgtactcagggctcacactttgcttggctccgtaagtcctagagaaaaatggtatgagaaatgaattcacatgaagcattagtgccttagtctcttactgtttttacctttcccgtgaatatttgtgcttacaaaatggtgtccagaaaggcagtgcctcagcgagataaatatgtttctaatcttagcatcttgggcagagtgaggctggcatctgaggtcagggaggccacagggccacgctactgaccgcattggtaacagactccattaggttgacagaaaggttaaggttcctggaatctgtctctaaattctccgtaccccctcattaggttagaagccaatgccaatacaagtaaccaataccaaaccctctcttgcttacagaggcattattaagttgggggctccctaagaacaattcattgcaaataattgttggcacatttattctcatggcacaactttcaaaagcaaattaattataaactggttgcaatttaattcagtttgtctggattatgtgtttgcaaggcctagagtacatttggcaccgttgctggcacatttggattttaatgtctttgacaagccacagcttccttggcctgggtaaacggcctactgccatactgtcatttaactagattgcgtcagagtgactctttagcttcgcggtgggtcttcagtttacaacctccacgccaccccatcagccgcacgggcatagatctcaacatgtatcaggaaactggaagaaagctgtgaacagaatactctgagaaaatgatggttaatcgtgtagaaaagtttaactatttgcatcagcacaatattacacaggcacatacgactttcagttccctaaacctgagaaaaggtttaacaacattgtgtgaaatctgacatcttgctattcatataaatgtgaaaggcagattgggaaaaatacagtaaaaaccccgcttttgtgcagagaatggtgcatatttttcccctaattatggaaggtagccttttatttcttctgaattcattcatttctgagcctgtgttttcagcttgcttatgaaactcaattataaaaccagggttaaaaattaagtcaagtcacaggctatactcctctttgattctggggctcctgagaacttccagccctctgccactggcttgaaaaatctctacccttacaaatctctcaagctttcatgcacctctcctacacagcagattaattaaggaaaaagatggaaaactcctggcaccattttatctttccaaactgtgatttgcctcttccccctaaatcttcccttccctctcttctgctcctttctcaaaaagaaagtgtatgattgtcaactttctgagttcaagacagtggaggattaaactggccttactgagatttgaacttgtgactcaagtcattggattttgtgaaagaggcccaaactctccggactggacaggttacagctccggtttctgtccctctgctgccttttcctgggtagcatgatgatctctggcatttatctatctatgaggcttgcaaaatcgcggcctgtcataatggtaaataaaatgtgttaaagttaatatgaagaagaaaggagcaattacaactgcttaaaacagtcttcaaatatacttaagcagaggtttgccacgtaaacacacaattaaagcaggaatttgtgatggatgcaagggtttgacggtcccagacatactgtttactggtgtagttagcagatggataagtcaactgatcccagatgtgcagcttataaatataaactcatgtcttactagtgatgtatgtctgcaagtagcaacaaattactttctatttaactcttgactgtttactagggggagctttgtaatgctcacttgcttaaaaaaaaaaaaggatttttaaacaagtttcctcttttaaaagtggtaaccaaatatctaaaaaaaaggtactttggtgcagaagttgttttaaaggacaggtttaaataggcttacttttttcttttaagttcagatacctaagccttatgtccctagccgcagttttcagatatttgcagctaattaattcttaggaaatctaatctgaattgaattaattttcccttttagggcacacgaagcaacttttaggtaagaaaaaaaatgaaaacagcttttgttgcacataattcttgcaactaatgaaaagtaatattgctgttcccttcaaataatgcaataacaaaacaccaaatgagagcattgcattgtattgttatatttgctgtttaaataatttagctgcaaaaatctgagggctgctttagctgtaattaattattcattaatgacatgctaattgcacaatacctttgaatatttaacaaaatgcaaaaaccaggctctgaagttatgtttttagtgcaagggggagaagattctttagtccatcactgtaccaggaggacaaaaaaaaagtcctttttcagatgcgaggtaaagtagtagtagtggcctactttccattcaccatctcagtcaccctttgtgccgtggaatataatgtccttatctagacttaacaattgacagggtggtaaatcccttgacttttgtccaaatgatttctctacaaaaatgggttaattatcgcctttccctagctttttgactaacaaaaggccctggatctcttttttcctttctttcctatttactgtaaggagctctttgaaatgtgatagtttaatcggcaacaccttctacagggggaatactgagaggccggcctggccctgcctggagctcaggttgctctgtgaacattaccgtggttaggagatatgacctttattatgccaaagccatcctggactttcaggatgaaaaactcctgagtgctcggtagtcgacttcatttgtttctgctaataaaagctggcgggtttttaacagtgtcttttagtgggtgggatgactaaagggcacagtgttgaactggcttagctgtgtttcactaattccctgcaagacagcgagtttgcatctttctgtgtcctgtctctgtttccaagcctgaaagctcctcattgtctctgacctgtaagtcagggatactcttcgtagtggataagcagagaagaggactagctttttttctttttatttgtcattatcaccctcttggtcccaatcagagaatcaccagcccctaatttagtacaaggcagtgagctgtgtggcagcttgtccttgtggttgagaatatatttcatgcactagggcctacttagtcatattttgcatttgactgccattactattaatggcatttatgaatgcacattggcgggaagaagaccccattgaatctgtgcattatcagagattggggaattagcatactccgtgtctggttcatgatggattttactgtgctgtggaaatacttagcaattaaatgagaaatcaccattgtgaacgtgcacctgccaggaaaaaaagaatggagtagagaaggaggggcattcactcaagttgacgccaagttccctcttttgccattgccttctctcatttgggaaatgctacatctgcctgtagccattgttcaacatggcaatatataatagagccactgtttagtaaacgcatggcatcacaggcccacccagccaaaagtgtgtcagggtcaaaagtgtttatagtcaatttggaagtcacagcttgcaaagtgaaaagtgaaataatgcaaaagtaatgtatgatttagtgccacatgaattagagagttcagggattgcaaagtggcaaaccatgcgttcagaccaacccagagtcagatgcattttacttggcttgaacttttttcattctaagttggagttaatattgaaaaattgggagatttatatagaaatctgactttccatcttctcttgaaaagtcagaaggtctaccaacatgggctgccagccatcccacatggcaacaattggccagagctaagtagcccgggcttgcatttttcatttgaatacctcacctgcctggaagtttcctactttggaatagagatttgaggtaggagtgactatgggttagagtgaacagggaaggatgacttttggacaaactccaccaaatacactctccacatgctggtggtatagtcatgatgagatttcagatggttcccgccactcatttatagccttttccttttccagagtaaaatgtcagagataaagaaggttgtctcccaggccactgaggaagtacttctttggctttctgcatggtcctcagaacggggccaattttactcgtaagacttcttgtatttcttttttagatctcagaatttgttttattaagcccctcttctgtgctagacactgggcggagcatttctcacacaaatccacttctttctggtcctgtgtgggctggactctagcagtagtcaatggaaagctttggactgctatagtggaagctctgcctggactgaagttttgttgtgaaataaatggcagtgtgaagaacaggttactattcttcatcggctactgactctaggactttagcctaccttgagcaccttttcttgggtacattcacttaggattaatgaatgatgttgttacataaaaccttgtttctgcccaagtcctgaagtgaataacatctaagggaagtaggcaggagtgccaagagaagccaatttcatcagtgttaattggagacctttgggccaggaaatagaagagcatgggtaatccatgtctccttagcccactgcctgtgtggaagccagcctgaaacttttgatgttacttagcaatattagggaaacatctgtgaacaggcaccactgtacaccactgggaattgcttaaaagtgatacaacgtgaacctgtcaagtgacaaatactgctgtgggagcatgacttataaactgtgtgaacacagttcttcctggaagtatggattgagctagggagcggtggttaccaggagagaatttgttatcctagtgtgaattagggaatgaatatctaacatgagacaactagagcaggggaattcttggataaatatgggtagggtgtgtatggcttagcgcacatttgaagttcatgactgagaagatttacttggtgaacatttattgaatagatacaatgggaaagcctgtatttgttgaaagaggcagatatagacatctaaaccaaagtaccacattggccagccatgtctagattgggtgtgggtcacctttttatcttctaggaaattatcttacttgttgaagtggcctcttttggaaaaagcctgaacatagtttgtctattgtgatctgttctttttcctgaagaaaatattttctttttagtttttaattttaaaaagtttaaaaagttgtttttgtagagatgggggtctcactgtgttgcccaggctggtctcaaactcctggcctcaagcaatcctcccatctttannnnnnnnnnnnnnnnnnnnnnnnnnnnnnnnnnnnnnnnnnnnnnnnnnnnnnnnnnnnnnnnnnnnnnnnnnnnnnnataaatgggtatgccatcacgatgtggaaactatgataattcgaaaattaaatctgctcaaatgcttttgtggattgataagagacaagtgattatggatcaagtcattaatattcatcaatgtaaagaataagttggggaattatatagaattgtaaggagaacaggaaaaggtataaaaggggatataaattactattctcctatatgcacagacaaaaatcacaaatgtctagtataaaaaaggaagggccttgaaatccattggcatttccagaaaatattccatgacctactcctgttgcaaatgtgccttttaccattgcagggtgataaaatgccatgatccaactccagagtacaattaagggcttgtgtgatacagcaggcagccattccatacttgagagttttcattgtataattaaaataaactgaggggcgggaggcaggggatgaagtaggggaggaaggtccggctgaagcgtattcagacatgacattttctaatgtcgataaccatcgagagctcggcttctctgtccatgaagacgagaatgccacatgtcagtcaaaggcagggtcgctgagcagggctggagactggagaaagcaagggagggttcatttggctctgggagagcgcagaccggcctcttctcaggctttaattgtgcttcctttgtgtcagtggtgtccacgtccagatttctgaagatgagtcctgatgatacagagagatagcaggtagtgcaaatttggctctcccctttcaagctgggattctaggccatgcttaatcccagtggaatagataaaaataacacacccaaggagcaatctcagacttatgtttttgaaagccattttaagcaattttggcccttatacagtatgcttgaataatgcccctgctacagtggtttttttttttaagcattccagtgtacatccctctgtgaggggctctgtcactctatttatatcctgtagtaaactagcttcctctcctttggctgggcagcagctgccattggcctgccctcgggcctcccctacatcacagagacaagcatgtgtgtgagaagaacccagatctccccccagcaaagaacggaatgagggctccaacctgggagaatgtagtgatgttttgacacacccacccgtaccctccaccccgatgcaggaaaaactggaatctctctgttcctgtgacagtctgtcaattttgcttccagaatagttcttaggaagcacactcaccctctaggaatgggggattcatgtcttaaaagatcattacaagttcttcagtatatgctgaaatttttttctgttgcagtgctggaggtaaataccaagagaactagtgctttaaaagcaaaagctggttgttaatggagtaaggatgcttcagcgatttagggagggaacttttaaaagggggctccacatttctcctgttctccttcaacctccatttctacacaggaggtaaatgattttcatcccaactctttactttcgtatttagctttgctcagacatgattacttctcctttacgatttctgttggctgctatccctctgtgttcctcctgaatctagagttatagattgtcatggcatagattagagaaaaccttaaggaagttcccaggcaagatggccgaataggaacagctcctgtctgcagctcccagtgagaccaatgcagaaggcaggtgatttctgcatttccaactgagattcccagttcatctcattgggattggttagacagtgggtgcagcccagggagggcgagcagaagcaggacggggcgctgcctcacctggaaagcacaagcagtcaggaaactccctcccctagccaagggaagccgtgagggaccctgctgtgagggatggtgctatctggcccagatactatgctttgcccatgctcttcacaacccacagaccaggagattctcccggttgccaataccacaatggccctgggtttcaagcacaaaactgggcggccctttgggtagacaccgagctagctgcaggagttttttttttttccataccctggtggcgcctggaatgccagtgagacagaaccgctcactcccctggaaaggaggctgaagccagggagccaagtggttttgctcagtggatcccacccccatggagcccagcaagctaagatccactggcctgaaattcttgctgccagcacagcagtctgaagtcgacctgggatgcttgaggttggtggggggaggggcatttgccattacagaggcttgagtagatgtttttcccctcacagtgttaacaaagccactgggaagttccagctagggggagctcactgcagtgccacagagccgctgtagccagaccgtctctctagattcctcctctctgggcagggcacctctgaaagaaaggcagcagccccagtcaggggcttatagataaaacttccatctccctgggacagagcaccttggtgaaggggcagctgtgggtgcagcttcagcagacttaaacgctcctgcctgctggctctgaagagagcagcagatctcccagcacagtattggagttctaataagggacagactgactccttaagtgggtccctgacccccatgcctcctgatggagagacacctcccagcagtggtcgacagacacgtcatacaggagagctctggctggcatttggtgggtgcccctctgggatgaagcttccagaggaaggaacaggcagcagtcttggctgttctgcagcctccgctggtgatacctaggcaaacagggtctggagtggacccccagcaaactccagcagacctgcagaagaggggcctgactgttagaaggaaaactaacaaacagaaagcaatagtatcaacatcaaaaagaaggacgaccaagcaaaaactccatctgaaggtcaccaatagcaaagaccaaaggtatataaatccatgaagatgaggaaaaaccagtgaaaaaggctgaaaatgccaaaaaccgggatgcctcttctcctccaaaggatcacaactgctcgccagcaagggaacaaaacaggatggagaattagtttgacgaattgacagaagtaggcttcagaaggtgggtaataacaaactcctttgagctaaaggagcatgttctaacccaatgcaaggaagctaagaaccttgataaaaggttagagaaattgctaactagaataaccagtttagagaagaacataaatgacctgatggagctgaaaaacacagcacgagaacttcccgaaacatacagaagtatcaatagccaaattgatcaagtggaagaaaggatatcagagattgaagatcaacttaatgaaataaagcatgaagacaagattagagaaaaaagaatgaaaaggaatgaacaaagcctccaagaaatatgagactatgtgaaaagaccaaatctatgtctgattggtgtacctgaaagtgatggggagaatggaaccaagttggaaatcatccagaatatcatacaggatatcatccaggagaacttacccaacctagcaaggcaggccaacattctaattcaggaaatacagagaacaccacaaagatactccttgagaagagcagccccaagacacataattgtcagattcaccaaggttgaaatgaaggaaaaaatgttaaggacagccagagagaaaggttgggttacccacaaagggaagcccatcagactaacagcagatctctctgcagaaaccctacaagccagaagagagtgggggccaatattcaacattcttaaagaattttcaactcggaatttcatggtaccagtaccaaaacagatatatagaccaatggaacagaacagaggcctcagaaataacaccacacatctacaaccatctgatctttgacaaacctgacaaaaacaagtaatggggaaagaatcccctatttaataaatggcgttgggaaaactgtccagctgtatgcagaaaactgaaactggaccccttccttacatcttatacaaaaattaactcaagatggattaaagatttaaacctaaaacctaaaaccataaaaaccctagaagaaaatctaggcaataccatttaggacataggcatgggcaaagacttcatgactaaaatactaaaggcaattgcaacaaaagccaacattgacaaatgggatctaattaaactaaagagcttctgcacagcaaaataaactattatcagagtgaacaggcaacctacagaatgggagaaaatttttgcaatctatccatctgacaaagggctaatatccagaatctacatggaacttaaacaaatttacaagagaaaaaaaccaacaaccccatcaaaaagtgggtgaaggaaatgaacagtcatttttctaaagaagacttttatgtggccaacaaacatatgaataaaagctcatcatcgctggtcattagagaaatgcaaatcaaaaccacaatgagatcccatctcacgccagttagaatggtgatcattcaaaagtcaggaaacaacagatggtggagaggatgtggagaaataggaacacttttacactgttggtgggaatgtaaattagttcaaccactgtggaagatagtgtggtgattcctcaaggatctagaaccagaaatacaatttgacccagcaatcccgttactgggtgtatacccaaaggatcataaatcattctactataaagacacatgcacacgtatgtttattgaagcactattcacaatagcaaagatttggaaccaatccaaatgcccatcaatgatagactggataaagaaaacgtggcacatatacaccatggaatactatgtggccataaaaaagaatgagttcatgtcctttgcagggatatggataaagctggaaaccatcattctcagcaaactaacacaggaacaaaaaagcaaacactgcatgttctcactcatacttgggagttgaacaatgagaatatatgggcacagggaggggaacatcacatgctggggcctgtaggggggtggaggacaaggggagggatggcattaggagaaactaatgtagatgacgggttgatgggtgcagcaaaccaccatggcacatgtatacctatgtaacaaacctgcatgttctgcacatgtatcccagaacttaaagtataataataaaaaagtaaagaataactgatgaatttcaaataagttttgtctctcctgcttacacaaatcaattgcttgtggctgcttggagtgctttgatgggaagtctaggaaggcgcagtccgggctcagtggaaatcagtgtgatgataaagctttccctgcacaagagggtctggcatttccaactgctgattttgcataatcttattttctatagattatgagagaaatgattataagtcacttgattgacccaaacatggagcagttgtgctgcatagaatatttcaatgccttctttcccatttcagggtccctggcgccccctgccctccccactattctgtttcccatttcagttgagatttcagagatggttcacagttttcccaggaattcagacttctgcttagaagaggcactgccacactcttaggtaaaatctgctcagcttgcctccctgattctagaacccagaatgattctggaagttatgttagaggtcttgtatgcatatgtcaagagagacctgttctgtttagaagcttttctggggagatttggatccagttatggatgccacgtataatatatatcacaactggaattaattacttctttctgtaattattatatagcctttcaccttgctagattttaagatccaaaggagcactgcttttttctcttcttgtgtcctcagagcctggcacagtgctcccggaatgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtagaggttgtcacagttattactactccctggtactcgtcgcgatctgatgtgggacctccaattcttgggcaaatcctgccctttggtttcagcaggtgtgtggactgagaaaccgtcctgcacacaatctccaagttgttcagtcctcttccaggtgaagcagtttgcaggatccatcacacccagctccttggctagttgctttgtggttctcttactagcaaaggctgcagctggtgattctgctaaattgaagtgagaacaagaaaactctcccagaatgcaccagggcgaggcaaggcactacagctacccgccaggtaagtaagtactgggtgctgcagttagaaagagagcaggaaagcccctgggtgaagcctttaatgaggagagtggtaagagggtataagtgtattccttgagagggtataagtgtattctgtttcagaattccaaattggaatattcagacttcataatccatggtgtttgttagcttggtagttgtgcgcctctgtgggatcctgggctctgtgggtccaagaaggacagatttccatgatgacattttgttagatgatttctgaggtaggagctacctcgcagcctcccccacccccgcccggaaagcagacacggttaatcctccatgactactgatattcgctgattgagtgcttaaaaagtggcagactaaagattttcctacaattgtagtgcagatgtccacattccaccaaatcataccacagagcaaagtctgattatgtcattcccctgtgtgcataataaacccaaacttgacattcaagataccaaatagcttcccttttaactaaatttcaattaaatccaggtttgagccaggtgtgctggagattttccattttcttgcccttgcttattctggtctgctgatctggtatacccattttctggtcatcatcttcacgttgactaccagcctcttctaggaggctttccagctccctctaaggcagctggaagtactcatcttgcctctgaatttccatagcatgtgtccatgtcttctggcactttcagctttgtactttggagcacaggttatttctatgtgcatcttttctctgtctaggccataagtccttgagggttagtttctagtttatctttgtgtttttcagaagactcagcccttgtcccgcacataataagccctgaggtacatgtgaggccaatgagtagcaccaagtgcccacgggctccatttaatgtgctgctcctcttgatttatttagatgcataaaagcacatgtgtgccaggtcttgaaattacagcagaaaataatatggacacagctcttgctctcctggagactggtgggaaagttggaccagtaagcacacgttatgttcagtgattccatacttaaatccaggatgtcatagatgtctcttggaggggccctaagctaacatttaagggtaggtcctaaaaaaagaagagctttgagctttgaaatgttatagactgaaagtttgtgtctttccaatattcattatttcaaagctccaacccccgatgtgatattattaggaggtgaggtttttgggaggtaattaggtttagagaaagttaggaaggtatagccctcccctgccatgatggcattaccgtcttcataagaagaggaaaagagaggagagcgctctctctctcgttctttgtgccatgtgaggttgcagcaagaaggcagccctctgcagactgggaagagagccctcagcagatattgaatctgcagcaccctcatcttggacttctcagccttcagaactgtgagaaatacatttcctttgtttatcagccacacagtctatggtattttgttatggcagccccagccaactaagacagtaataaagatgggaagagcatgagagtgtttgggacagagggaacagctgggacaattcccggaggagaagggaacatagcttgtttggaaaaccctaaatagcttataatgctggagcagaggaggggaggaggggggtgaaaggtgaagctgcacaggctgtcctgggtcagggcctggaaggcactagggttcatgtcagaaatgctggactctcccctgggagcaaaaaggaggtgattgattaattcagaggctatgttaaagtatcgcaattttatgttggttattcaggatctggcagtaaggataatgagtttcttttgaattgaaaagggtctcaaacaaaacaagaacaaaaccaaaacaaaaatatcaagattccaggagcaaagaccaaggcacttgagccggagtgaaaattcctccttcaaagaaaggtacattttgccttatagtgtgaacatgccaggtccacgacgagacattattctcatggctctgactggcagccaggagccatggaggagctcttgaagtgaatgggaatatttcttgagtggtttattgagaaagcacaatggccaaggggtgggtgtgggggacaatgcttcaggctctcgccagtgggtgcctgatgaaatacatcttgacgtgtcattgaagtgtggagccgtgcggccccgtgaggtcacctgtcccaccccctgcccaggcagattattcctcacactctctttctcagctctttgtccagtggctttatgcacctcaagcgatggggcttccactgcctcccttgggaagccattccgcactcgaatagagcccgctcttaagaaggttgccctgatattcagcccaagttttcctttctgtaattacatcccattccgctctgctctacccctttgcgtgaccctgagcaattctttcccttcatcggtgtgcctacacccttgctcagggagagtatttgatcctcggttctttttgtcatccctgagctttgcttattcctggctggtgctgcgggaacccttataagtagctcctgctgctgttctctttaatcctcgtggcttcccttctttgatttctgtccaatttgcctatttctttcaggggtactgaagggcccagaatgaatccgaggcttcctaactatattatttattaatattttatatggaagaccttctcaatgatgctaaaccaggttgggtggaaaataaaaatctctttgaaagacggagctgatgtgaactccctgtgataaggactctggacacttcagaaaaaaatgagtttgaatgcaaggaaaagtacccccacccagtcttctgatattcatgcacctgtacttcattgtactattgagggcagaggaagcatgaatttaggccaccgagagactgaaatgaccctccccagtcagtcgcactaagtacagcctattctccaagccaagctttcggttgccctcctccatgaccctctctttgatctcccctaacctctactttggtataagcagataaaaacaatccctccttcctatgactagccacagtacttttgcagggcttgctttggtggtacttcctattctccattttattcatttacccatccagcaaacatttatctcgtgcctactctgttcgtgatactatggctcatactgggggaagtggaagatcaacaagattaaggttacagggcaaaattcttgccctcaaggagtttcccatccagaggaggaagccagtgcatagctgtagacagatgctggagtggaaatgtgctggaaaactgcatgactatgaaataggagtgacttgcaatagattctcattcttgttgtggattgtgagcttgcaaatgtgggaagggacactgatttatctgggtaagcctacgaagcctaccgtgtgccatccacatgctgatgttagtatggtgcactcatatgtgccaggcaatgtgctaagcactttgtatgtgtatgtcatttagtctttacaactttaggtactattattacctttacataggaaggaggaaaccacgtctctaggatacaaagtaacaaacctgaacctgaagtcacagaggtggcaggtggcagctgagtttgaactgagaccctttgcctgcagtgtctgttctcctgtgctctctgctatatatatgtgggtcatccattcatgatcagctgagatgggaaactgaggcaggaaatatggttcacaaggtagctaatcaaagaccattttcatgtgttatcccatgtcacctcccctttgctggtcttggcaaaaaagcaaaaatggaggtagcaaggcattttgtgttgtcagacacctagggaacatgcacatatatttatttatcatttcattggttgctttggaaagaggatggaaaaccaagcctctccttttttaaaaaatattttctaatccagtagcatcacataattcaaccagtctatcttgggctattgaggagcagagggatctgtctcagacaatggccacccagtgcaaagatagctgaataaaaatgaaatatgaatcatctacttatttgaaaaacctctgggttcttggcagatttttggaatcatatatattggctttttctggcatatacccagcacagagtgggtgtttgtcatgaatttgtttaaatgaatacatggtccctacttcagatacattttgcacttttttgggtgagagttgtataaatgtgctccagccaagaaatggctcattatagtgatgggaattgtgatcatcttaaacagagtcactaaagggaagaaaataatcatgttagtttgtctttttctatgtgctatccttttgataaatgccttttttgggagatgggtctagtttttcttctgcatatgttttctaatcatttgtatgtatctgtgtgtgcacgcgtgcacatgcagtgagtctgcagcagtggatatagggtgttctaccagctggcctgccccagttcacttatgctaatctgggagtgggacagcagcacctgtgcccatggctccccagaggcttgctgggcaagcggggtggctgtgctgcagcagcacatttgcgtctccggaatgtgtcctcagctccttggtgcctctggactgtgctctctgagttcaccttaactgtgccctcggaacacagcctctgactggctgctgcctccaagatgcctctggcaaacgccttgttctcatcttctcttgggcaggggaataggatgaggggcggggagctggatgaaggacacttgcctgcccgagcacctccattgaggccaaacaaaaactgggtccaccatttcccaagaataaacactagtgccaatttttcttaaatgtattttaatctaatagattaaaaaatgtagtgtagtcagttacatcttaggctctggagccagcctgcctgggttgcaccctggctctaacacatttttgttgaatcttgggcaaattaaactcaacaagtctgtttccttttctgtaaaatggggataatgataatgtctgccttgtagacttgcaatgagtgcaatcatatacataaagaatttagctcagggtcaggctataatttttacttactgcttcttctgggaaggacatttagtgaatactatgtgccaggcactgtgctaaacgttttacatatgttgtctcctttgatcttcataacaacctactaaggacattgaagttatttgactaaataacttgtgggaattctaactcaaatagttatgaaattaacagaggaaaaatgtttggactgattataagttctacagtgccagagtctgtactctttccaaatattcaacactgcccattgcaaggtctgtctgagagttgaattttgagtgagttatttgaactacgaaaaacctttgaacttgagagctggagaaagaggaagaaaaaggtcagtcccaagatctttcactctggaagcttccatttctctctctttcaaatgacctcccctcatatctctacagagtggtatggcatgcagtcttccagataactttaaggagacaattcagcatggcgatggtgggattgctcttgtacgagtgtgtatgtgtgtatgtgtatgtgtatgaagtgcactgtactacactggcattgcagaggttgttgaatgaatgaatgaaggaaggaactaatatgcatataaatgacacatggttctaaagtgagattcggctcccataagtcattcaggagagtctgtgtcatccctttaacctggtaatcataccacatacacactcctacacccaacacacacacaccattctcatttgcctgtgtgtaatgggcatggtgaaatctgcctgtggctccatatcatggttttgagattctattttcaatagtacgatagatactgaatgagggcaagtttcgtttttgtgtaattcaataaaagagcaaaatacaaaaaagagtcattaaagcattgtgacatcaacgcagactgtcctttgtggaagtgcaaagcagaggaggtgctgtgtttactgaaagatctgtgctttcaatttattcatttgggttcttttgttttggggtgtgagcagatctaatttatttgtttttgtatgcttactttaaagtgaaaaagaaacctatattgaatgcctactatttctccagctctgtgttaggttacttagcttttacacaccctttgagaaataaggtgagtgaccattggctcagagaggttaagtcacttgcctgaagtggcagaattactaagcaacaggacaaagatgcaagtcctggtctctctgttctcagctgtctttcttcctcctcatagctttgaaaagattcaaacaaacaatcagtgaaccctttaatgagtagttgaattttatttactctccagtagggaaaaatctatattatttttctgagcatctccaaagcccacataaatcctgttgtattaagaatttgattgggaaaatgttaagcatacaatttattgatcccctcatctccagctgacaagatggcttgttttgtgcacctctttcggtgtcttcattttagttgtaattatgttatccttcataagaatgatggttgcctatagtggtaagttttctacctgcagctgaactatccccgcttcctttagcaaaaagcaatttcaaacattttttttttttgaaaaacagtctctgggaaaaagtttacatgtcaaaatatttctcccagtttgctttgaatttttagttttcaaaatttaagtgataccccgtatgtatgtattgacagtttctcactgattaggaagaaaaaaattaaaaaaacaaaagagtaaatgaactgagccttggctacaattatcctaagcccagtgaaaggaaaagtggcttcagaagttctgagggatcagagaccagggtgtctatcactctgtaaagtgagtaaataaatccttcaaggaaaatatctacccatgaggatcttggaccatgctaagaaatgatctgggctccaaatgttacactcttgtctcatgtgaatctacaggcaactttatacaaactgaggtaactattatgggtttgatgtacagagatacttttaaaggagtgttctgggagtgccctactaaaagtctcataatagcagttccagcatttcagtaatctctgggcttgaatgtggctaaatagttatgaagttcatagaggaagtatgtgtgtttggactgattatgttataaattatgtaatgatataaattataccataatataaaacttctaataacatctgggtatattctaaaaaagacatattattgaattattttataattttcatatttaaaatgaatactttttacaaagtataaagataaacattaaaattgcctttcactttatcttccctcaataaccactgttcacgcttaggtatctgttttctactcttttattttattgcttacataaatagatgcattgaaatttatgaatatgaggacatatgtgttatacctgatgttacatctttagccctctccttgttgctatttttattaatatgcattctgagaacacatgttttttaatgactgtataatattgtatcatgtggatatatcatcatttatctaaccaatctgcaattgttagacatttaagtttttaattttttcatttttataaataatgctttgataagcatccctgatttccttatgatagattcctagaagtgcaattacaggctcaaaggatatgaatgttttcaaattcttgatgcaataccaaagtgcttcccagagaggctgtgccaatgtgtgctccctcccctcccacgggtgagagtgcccatccactgtatccatactggtgctgagtgctatcattacttgacatctttgccattttattaaagagcatatggctggttgctaaaggtaaggtggcaaacaaaaaaaactgtgaagagaagcagaagtttaaattccagacaataaatgaaaattggtaaaggcatctggttcttctagaaacatccttccattaatttgtagatgagtatctcctatttctaggaggatgtgtcaacatttcacagcctcctagagtattagctgcccctatgcctctctctatatattctcatctggcattaatgcacattagatagggatttggaatgtttaccaccttgttagaacttctgagccatttctaatttctttcctatgctgaaccctccaataaaaagcaagtgactgtttatataatattagagcattttgaggtacctctgcagctaactagtttaaaaatgacaaattaagtcaaagtttgatttgctccatgatactgatgtttgcatttcctgagatgtttcagggaactgactaaaaattttgatggagacagtctttgagagtgttctaaaaaactccacgaggtcatctaattcaaccccttgctctaggatcaaaccagcccaaaacatgaataccatgaggaaggaaaacaattttcatttttcattcacagtagttaagtgtattgacaaaatcccccgaacacctgctttttcctgatctgtggctgggtagtcagtaaataagtgtggagtatgttgagcttactctgaatcagcaacaccgctataggaaaaatagtgaccgctttaagttataaaatgtgatgggtcagaatggcttttctttggcatttaaaaaaagtaaactagaaatgggcagcttagtgggaaataattactgttggctaaagcaggtgagatatgggactggacctgctgctttgatgaagagtttgctgtgcacagcatcatcatttccatcgtaagaaaatcagagatgttcagcaaagcattgcttataaaaatgaaagattaaaaatgtagatgtctaacactggacccccatttgcaaagaaacaggctgccatagaaacactgtagagctttttagtttgtgcaagatatgaaaatgtgtttttttttttgggtaacctgagaaaattaaaggagaccattttgaattgcagaggtggtatgacttggtgagattggaacagggcttatacttgctttgcctctgacctgggataaattactttgctcagtttaccttatctgtaaaatggaggcattttaatacttgccccccattagatgccttagaaatgtgaacaagcattttgaattcttatgaagaaggcagtgtggaaattcacagtgtgataaataaattcctaaaatgcatcatacaaccatacttgtgtttgggagactggaaccattttaaagaaaaaagtatccaaagtatcccattcttgttcaagtcaaatgctgaattgtgtagtggcacagcctatgctaccagggtaggactacatagctttacctccagggcatgggaaggtgggcagctcagtgtgatcagaggcgcagaacctgccgcatgatggccaggctcagaggagcatctttttacccatatcttgttgattccagctttccttgattagtcatttgcatgctcatttttgttctgttcctctctggcggggtctgttaattactaaacatgggagacttaacaaccaaaaaaaaacaaacaaaaaaaaaaacaaaaaaactagaaaacagctcgagccttttttgctcaagttttgttttaggtccagtaatttgaattggcagccaaaggaaaaaaaaaagtaacagatacacctgactaacttgcatttcgtatttctaacactcaaaagtacaatgcttatggtaatgaattttatctattacgagggaaaacaatcacctttgatgacattatagaataaacacatttaacagcacgctgaattgctgaagtatcattttcaacgacctcattagtgtcacttaattaaaacttcctgctcttgactttgatgctggtacaggcaaaaacacagagggaattgaacaaacaacaaaaaaggtgtagggggtgcattttctagtgataaatcgcagaggttgctaatgaaaccgaattatgtacctttttcctgcaactcccataaaataatctgaaacacgcagcaactttgcatcaaacaaattaatcagctgtcagcagatttgccttataataatcttttgcacttattgatcatttaaaaaggggaggggctttttttctctgtacacaagcattaggttggtgataattaaagcctcagcttcagaaatgccataataactgttaattagcaggatgctattttcaacataatttgctaattaggcagtgagctggtatagtgtatatacctaattatgaagggtcttgtgctgtagacacatgtgactggagtgtaaatgacaccattataggggtcctagcagactttttaaaaatatagtttgttcagaagtacttagttctttagggacttcttcgtatagggaatattactcttggctgttttgcatgaggcttagaagaggaaacattatgtagaaatataccatttcttttatctgtactgtggacagacagggtcactaattctaaagaagctttgtcgcctgatgcctgatacaaaggctgataatttaggcactgaagttgtacatactctactagtagagaattactctctgtttgcttgccacacgcgattcatctgtggaccaggacgctctaaatcttttaatattatatgtctgccatactttgatttttctgccacacactgataacctataacatgtatctctctgcctctgtctctccctcctacttttcccttcatgtcataaagaaaatctagacttttcgaaaatggatgtttatttctgcctggtttcttctctagcccagtgtctaactgtcttgatttttaaaaaaagatttaaaaatttttaaaagagaggaatgataaaacacaaaaagtaagggtgagctgtcatgcaaaagtctcaaattatatgcatattagcaatatttatgagtttaaatttggcttttcagcagagcataagcagagtgagatcatttgcagatatataaactggcttcctggatcataatagctgatttcttttaaatgttttaccttgtttcaaataaaactatatttctttattccctttaaacgaaatgaaaacttaattcaataataaatgagcttcagagcagcacaagagtcacttaacttaaatctttttgtagaggttcccacttaagcggcttgaaagacagtaaatcacactgaagaatggacatcccaatttcattgctgcgctgtagagagctgaattaatggccttctctttagaatgtatggatgtgctttccagctgctaagcctgacagtgttatagctcaattaatgtgattttgatgtaattgcagatagggagcatggtgccaaaaaattattttttttcataagaatcacattttatcatccagatgtgggcagaggggtgctttttaaagctgaatgtgataagtaacagggctcctatttctgtttttttgataatatatttctgaaaaaggggagaacaatgaatgaacatatttatttattgaacacttactatgtgcccggcactgtgctaagcattttactctaacatatcatttgatctttacaagcctatggagcaggtcctattgtcatccccatttcacagatgagaaaaatgagtcaaagagagatcaggctagtagaggcaggcctgggagggatttgaacccttatgtatctgacaccctgagatcataattaaccatcatatggtttctctccaagttgtcctcagaggcctctggctggagatagtaggatccataaatgtttaaatggttaaagcaactttttagaacattatagagtggtgttgtgagaaataggttttaggcaggctgcctgggtgtgaagcctagatctgcagatttctagctgtgtttgattttaggcaatctgtttaaacaccctcatcctgagcttcctcaactgtaaagagggtgtactaatgatggcttcttcatatgatttgttacaaagattaaatgagagaatctgtgtaaagtgttcagaacagtgcctggaacatagtaagtgatagcaaagataattgatagccaaacacaagccagcaaggtcattgatctcttccagtacagttttctttgcctcatcttatctattgggtgcagacggcctctgggaacttggctgccaatattttctgggaagtacccagaatggcatttagcatgatatgggctgtgcctgctggcattgatgtgaaaaaggcctttcttttttgaagccactttaattcctgtattattagaatgaataatggtgctaacttggaaaatgataagctgtgtacttgctggtatatatagcattacttgccagcccaagctctgctcatagatatgaggaaagcactgaatttcaggcactgtttggggctccgggacacaagaagaagaacaaagcagtggttcatgaactgaaacaaaactcaggacacctcttgcattcatgatagaagatctagttaaggaaagagcacggagaaaaatgatgacaacatcgatgatgattatgatggtaactggcatgtaatgagtgcttactattcgccattctgcaaagttatcacattcaatgctcacgatatttctacagataagaactagtgttatccctacttatagttgatggaaatgaacatcaaagaagtaatttgtccacagtaataccgctgcaaatctttttatgcatcttctcacctcagatccacattgcatagatggggtgaagccaccttaaatttgccttgagttatgggtgaaggcaggtagggtcaagaggcctggattacttttatttcttggcattcattgcatcaacaaggaaggcttgcttttccactggctcgttgctttgtaaataataacgtcctttatttgtggttgtattgattcggttgcaattaatacattactaaagtctgtatagacaacttattaagagggctattatttgtacaataaatcctgggcattttcattgctgtggaccaataatttaaataagatagttctttctttctttttcttttttcttttcttttttttttttttgaaatgtagtctctctgtctttgtcacccaggctggagtgcagtggctcaatcttggctcactgccacctctgcctcctgggttcaagcgattcttctgcctcagcctcccaagtagctgggattacaggtgtgtgccaccatgcctggctaatttttgtatttttagtagagacggggtttcaccatactggccaggctggtcttgaactcctgaccttgtgatccacccactttggcctcccaaagtgctgggattacaggcgtgatccactgcgcccggccaataagatagttatttctaataatatactgggttggaacattttgacatctaataatcctaatgtgtatggtgatgtcattgtttcttattgttaccttcagaatcaatatgcaaaagttaatattaaattttgacatcacaggggatgcatttattaagatataacaaatgcgctatcatttgcttataagtagacctaaatagaaatgagctagggtgcttggtatacttgttgaaatacacatagatatgaagagttaggctttattatttttatagaataatagttatggaaaggatttttgggggtttagaaatataacccttatattaaaggcacatttcaatggtggaagtataaataaaatgtattaagcaggcactatttgcttttataattttgtcttgaagtaaacctccaactttgaagctattgaaagaaattcctcttgtaccattttgattcattttctttttagagcccaccaaactttgttcctggacacatgggtagtgggaataatattgtggactgtttctgttcttatgtattagcacactgattctcttccaagagcatgaccttctcagtttaaaaacagttgatatattaattagaattaagttaggttgtaattaattcccactcatctccacccaccacactcctaccaaataacagtagcttaagtaacagaagcttgcttatttgtttgttttcctgtttaggaaatctggagatggtgcagtgtggggtgtggctctgtgatgttggggccctggtttctattttcttctgttgtgcatggctacaattcccaaggtcacctaaccatcagagagagttgctggagcttcagcctttacctgcacatggtggccagtggaaggaggaaggagagaagaagagggagccctttccctttggagatctttgaggaagttacacttatcacttctccacgcatccattggtcagaattagtcacatggccacaagggaggccaggaaatcttccatttatctatccagttatgcaccattcatttacttaacaaatatttattgtatattcactctgtgtttgctttattcctggcaataaagaggtgaacaggcagacaaggcccctattctgatagctcttgcatcctagcagggagctagacaataagataaaagtgatatgtgctgtgaggaaaataaagcaggttgatttcataaagaggtgattcatggccaccgatagggattactttagattgggcagtgagagattccctttccagaaaggcgacccagctggtgaatgcattgattttgggtgtgaggagaactatttcaggcagtgggaacagcatgtgcaaaggccctgagattggggtgagtttagtttatttgaggaacagaaagaaagctgcacacagtggcaagagatggctgtagaggagtaggcaggagtggggccatgctagagattggatttccttctaaaagcagcaaaaaccatttagaggggaggctaaactacagaaaggaaggatgggcacgtgattcagtttatcttttttttttttttttttttttttttgagacagagtctcgctctgttgcccaggctggagtgcagtggcgcgatctcggctcaccacaagctgcgcctcctgggttcacgccattctcctgcctcagcctccggagtagctgggactacaggcgcccgccaccacgcccggctaatttttttgtatttttagtagagacggggtttcaccgtgttagccagtatggtctcgatctcgtgacctcgtgatccgcccgcctcggccttccaaactgctgggattataggcgtgaaccaccgcacccggcccagtttatcatttttaaaagatcattctgaatgccacatggagaaaggtgtaggaaacagacctatgatgctgcctcactcagctgtggctggtgtggggagagaaggatttgccctctgcatctatgtctatgttgaacaaatgaaggagattttctttgtccagtggcatccagggatttgtgttctgccaggaccttacgatgtggcttttgcaacacactgaaaggacctgcatgttacagagacatgagggaattgcgtggaaaacctccttccactctgcagcatctggcatgaggaaggtagtgagctttcacagcgaaaaggcagaaagactgcaggtgaaatggaacaacagcccaccacgtaatttgccttctcggcaaattgtttacccatcatggggcagagctgatgtagatgggctgcctgagccccagggtgaacccaggagtggaatgctaggggataaaaagttagatgactaaaaactttgtcttgtcattctcacaagggacaatgttttgtgaataacacatctgagctgcggagaaggtctcaagggcttaaaactagtgattaaaacagtacaactctgtgtgaatgtagtttcaagtaagaccattaaaatgttgctgtacccaaaaaaggctaaaagaaagaggcagtaaacaatgcccaggtttggcttttgagctcagaggtaattgcttttgaatcttccttttgactggtccatcactagttcacgaaatttgagatttgttgattcagaatcattgagacttggatctgaaagggaccttacagtgaaatgggctgggcactggttttacacatgggtacaatttgagacccagaagaggcgtggcttgtccagtttcttgatttaagctatttcctctagagcagacttaaggaaactaatagtatatccctttggtataacgtggcttttttcaaatcccacctcccgccacccagcactttcattctttgcccgatattgcagaagctcagcagagctacatggcttcaacaaaactaaatttcctgttttgtaataaaattgatggagcgatctgagacccaccctccataataaggcaaaatttcttaaaatattttgaaagtggcaatattttctctaaggaataactgaaagatggattcattttcatcattaaatatgggatgagaatgccagataagttttaatctgtaattttaagagaaggagagagaggaggagatgatttttatggataaagtaaggttggggatatactttgaaaaggaagcttttcaggcagctgttaaaatctttaaaaaaattttacccccattggaagggtgttacttatcacctggacctggagaattttagagctttaggaataaactgacagttctctgattctgagcagtctagctttgctttgatgaagaggctaacgctcttcctgggttttgctggaaagccccaaggccttcgggctccacggaggggctttctgcgttcaaatcgcccctcctgctaatagaccacctaattggctaattgtaggctcagccattcatttcggctgcaattagccacttacttcttactttgcagatacaagtggccacttgaattctcaaaaagtccattgtgaattcagttatttgtgtgtctcattccacctggacagagagtggttagaaaaaagagtaaaataaaataaatgatagtccttgaaataaaatccctctgaaatctggctcaggctttctcaattctgaagtgacaataacctgaacagttcttttttcaaaaaatgcacattaaacataagacacacatatatcccagtaactggagacttaatttttctcttagtgtccataatgtagagcaagacatacccacctgctgtttttcagcttcttaactttccgtaaatctacttttccaacccttagatctgctgtgtgtaatttaattggctactgtacctttctgtataaaatgaatgtgctaatttctagagtgatgcattaattctctttgttatccacaaaattctggagaaatggaagatctattttaaatgtctgccccttgctgactctgtcttccagcaaagtggaagaactattgttttcctacacccttttgatgtggtcggttattgttatgttgggtcaaagggacttacctgggggatgacagatgcagacactctgccaccagcttccttagaagtgcacaatagcaaccaaatcaaatcactgagaggatactgggtagaaagttgcttttggggagaattctaggaaagagaagactgtgacctctgttactgcacaatgtcaaggacagatgggaagaaggtatgaatcaatatatgtcaacggcacagatggtatagccatacagtgtccacatcctgattttctatcccctgaaactgaaattaataatgccttcattataggcagtagctgccaagcagctgagagaacccagcacaactaagagcactgctctgagcaaggtgtttgaaacaggagttttcgctgtctgtctctgtctctctctctcttttagaagattaggaatgctatggatcgtgaggcaaaagggaatcatcttttgatgctgagttttacaggttcaataaaccaaagatagagcaactgtggttgcttcgtgctttgcaatatgtttgtgccagggaatctttccccaggttctggccatgtcataagggagagggttaactttgctgtgccaattattgggcttgcggtgttgaagatctcagaccagggttggaagtggagtgcaaagtaaaaataagcaaccacaaaccgccaaaacaagtattggtacatctctacaagctccggctggtaatgatgaattcagtattcatcacatggactaattaatgcacgctaacacagcccagtgcaatttgcgagtcacagattgcattaggtgatacaaatgactcatttgtgaacctgaaggatgacctttggcaggactatctgctgacctcaaaaatattaaagaaaggttatttcaccttgccattgtctccaaatgccaaaatagcccaattaaaaaccttgacttggaaccataggagcagatgcgagtcctaaagggcattaattattttcagtgtcagctggttgtataactgaggccaaatgagagtttggaaagctattaaggcagtgtattatatgcactgggtctaagatttgaattcagaataaggtgtagatttcatctatttaggcaagctgtatagaatttgtgctggctgtcctgttaaggattaagggctaacataggcgaaacgaagctcatcacccttgctgggttcttccctctgtaatcattcatctattttcctaagtctatttgcagaaccatcattagttaccatattgtgaggtcaaacgcataaacgtgtgcagcattagcttgcttccaagtggacttttctccctctctacaagtctaagcactgcaaatgatcctgtactatttccacccccaaatgtggtgacagatgaagatatgtacccaagctaggttcccatatggctaatttctacatttgttttaacaacatgcagatttttaggcaaattaaaacacagggacttccatattcatggcatcctctccagtgctgtcatcccttccaccaagtgggtttcagggagtcacgctggtgccagagcctgcactaaaaggaaaaggggcaagcatatctatgaggtgtgattgactcacaagagttcctgttaaaaaaaaatggagccaagtgcagtggctcatgcctataatcccagctacttgggaggctgagaagggaggatcatttgagcccaggagttgcaggctgcagtgagctatgattgcaccactgcactccaggctgggcaacagagcaagactgtgtttctttaaaaaaaaaaagaagaaagaaaagttcccttggcattgcctgctgcacatgcctttcaagtcactaacttttactgtggacactggccaccaaggcctgccatgtgtccagtaggtacaaagcagaggtattggagggcagggaacgacatattcttttcagcctctttagagctgaagtttcagattctggttcaccttcacatccagttgaaagggatggaaaaggtagaacaatatgataggaagtccaggggtttggggaccagacaaatctgggtttggatctcagtttggttatttagttgctgtgtaaacctgagcatgtccctaactcagcttcagcatcctcacctcaatcatgatacctgataggattgttaagaagattacattaagcatatgtgtgtatacacacacacatacacacacacacacacatatgtatataatgagcaccttttttggaatacatctttctaaatattgatgatttgtaatttctcatatatatatgttgcaagttatgtacacatatacctaaagaggtgctaggatatcatggttattgttatttttattgtggggaatttatagacagttttcagagatctgatttttttcctctagatttttctttctgtccttttgtggggctatgggcaatgcatatagcagaaaaacacagcttagaaattagagtcctgtctttaaagccctgttcagttggaaagttgcttaatcttgataaacttcagattcctatctgtaaattgggataataatatgtaccgtcgtgttttttgagaggattaaatgagataatcgatgcatatggtgcttggcatttggtaggagtttgatcaataaatgcaactttactctccttgccctcagaatattcctatcctttgtccccacatatgctgttaataagcctttagttgagagaagatgtggttctgtttcaggtttcccaggctagttccctggtgtttatttattcaaaaaaatgagcaccgttgttggaatatgtctttgctagacattgatgatttgtaacttctcattctcaaagttgaagggagatctgctttttcatttggtgtctttatgtttctctgttgttttccagcacattatttggtgacatcccatgttatagattaaaatattgcaggcatcaagattgttctcactggcctctcagatatgattggtgttatctatgagataaccctctccggggattttctcctctggctacttagaccacatgttacccaagcaacatgagtaccatgttccccctacaaggttgttattattccaaacttccatttcaaaaaaaaaaaaaatcttaatttcatcctaagaccctcataaatgccagcagctgatgaaagcaggtttgtttcttgctctttgggaggtggccacccatgtcagcactggagagtgtctgcacatcctcgcaggcccaacaagtgctaaacagatggagtgagttcagagctgaattaccaaggagaaaattctgttctttcaccaaatgtgatttttaacagccatttgcaaagaactctaggccatggaatattggaagggttggcttcatggataatgaatgccttagttgaaagcccattcaaactctgtcagcagctaatttctatatacaagccctcccttaacctaaatttcaagaaagcaagcatgcatttctgaatgcatgggctgactttgtaccagaacggagcttcctattggacagtaacttgccctaattttggtatgccttgcccagcacacaggatgctgctctgagtatttggtaaataaataataacttcagtgttagtccattctctccagagatgaaccaatgtaaagtaagggtaagtgtggggagtggagagagatgggtgagaggtgggtttagttacatgagccctcagataaccttatcataaagtggcttaactatacacacagtgttccactgagggatcagtaaattattaaatctcagtttctcagtctttctgtcttagtctcaatctctttatctcttactaattctctgtctcgtaacactaatggtaatccattcttccccagtatcagttctcaagccttagctcacagagaaatcacctaagaaactagttaaaagtgcacctcattagagttgatgtcaagagtctgtttctataaagttgggtgagcctgaggattctgccttttaacagaaccctcctccccaacccaggagatgctagtataaatggcccttaagccatgttttgggagaagctagatgatgctgatggagaccaacttccttcaccataagcaaggttgcaaaatacaagaagactgaaagagtttccagtagtttgagggctttttaatcattgctagtatcagtggaattctttaaacaaaatcgccataaaattcttctttcaaatgaaatagagaaagcctgcaaataaaacctctcccaagaaaagctgccctggctgaaggagagtgaggcctagggagccctgccacttgccttctctctctcttctgtcttcaatggcctcagtgttctgggcagtgttcctagagtacacatccccctttcttcccaaagggacccacgatgaaggcctgggtccctgtgacaggaaagatgacctcatgggatatctgagttctagctccagcctttcctctttgctgcatggcctcaggaaacttatttaacttccctgaccttcagtgcatcccttgaggaaaaagagggagtttgggctagatcagtttttctggatgtcccgtcattcacagactcgctgtgacttttgctatagatgagtaccacctggaatatttactccatatttgtctttataatagaagaagtctattcactgtttcttagctaaatattcacttaggttttgagctaagcaatgctctctaaaattaaaagtttgatgtgccacttacggtttttctttcctaacacacatgaagataaatacataaccactaacaagtgtgtatacctaaaatcagtggtttgcacatgacccttgagaaacatcaagccggatggtctctaaagacctcctgctccattcagtggagctggtatccaggtaggtctgtgttgttattactttggaggtttacagatgggggtaggttatagggaaaaacaaagaaatcctccgagtgttataagcaaatgaaaggagtaaggaggacaagaattgcttgtattgctggaaagaatgagggaactggaggcttggagagtatgtacgaaggatctaaatggttcaaagacagctttcaatattaattttgtagagacatagggccaccagctgcttgattttatttaggtataataggcagcttaataactaagaacatcattggtttcttgtttgtttcttttattgagtgtcaaagagctaacagtttttattatagatctcccagggctgaagttggctagttaggacagtggcaaggcaggacactagtgaagagtgccaggaaagagccttaccctgtccttggtatatttcgaaaactgagctctaaataaatggttttcaagagacacgttgtgggaggcagaggatgctgaagtcttgcttgcggcacacattgcagaaggaaagacaatgtttatgacctgcttattgcatggaaggggagacaatggctccaaatgtatacccgctgagctggcttggacaatgcacgcagacaattctagcagtcatggtggtccagagtaaggaaataaaaaatgtaattgaaaagtgagggaaactatagcatgattaaatttggccagcattgaagcacacagttataacatggaagtcagcccagagtacatattaggttaacagctttggcttcagagatagagagacctgggttcaaatcccatctctgccacttcctggatgtgattgcttggactaggtacttaatctttctgagccttagtttattcacctactaaatggatctaatatatacttccagggccaccttaagtatttcatgacttaaagaactttgtacaatgtttggcatatagaataatatcttagtaaattgtacatgctatttttacatgatgattttatcttgttctatcaaatccaatgagataagtagtatataggtggcccgtagagatggaaaggagattgctaagactctgccattttcccagaagtgcccattgtgtgcctctgtaatgctgcattcttatgactaatattaatcttgaaagatcattacttaatgatcttgagatatccatgacagggtcacttgtcctgccacatgaatcctgactaaggtttcaaggacaagaagtctttggacagataatttccatccttggcataaaggcacttctcagtaggttcaggaggattaagaagaagtaaagaactatgtatgacctgactgcagtctactcagccaacatcagccaaatttggacccccctttgtcggtcaggaggtcacctacacttgtcaggagctacaggtgttgaaggcatgaaaaggcaagatctgtcaggacattgcgaatcagtaaaaccagacctttgctcttgagagactcccacacgtgaaggttcttaataaactttctcacctgccagaaagtgtgaaagccttgaatgtggaccccttttgatatgcctggcattgttgcattgagttttgtcatccgtttctagaaaagataaagcaagcttattttataacttcttttcttgtttttacttactatgtcttcatcttcattaacgacaacaaccaagagtgccagaattctcttgtagcactaacccccttctctgcctccttgtctccctccgtgaaaaggcaacaggcatctgtttctttaagggccacagatctccttactgtttgtgccataactaagagttgcttgtgtgtctccacggaattccccccaccccgattgctttacataaatgtccaattaatgctagttaaaagttcttgttcatgatctgtctgaagggagagacaaagaagggaagcggagatggccccgctgctgtggccatgtcctacttctgtgatgcattaccagcaacttctttccacatgtttttgcattgtttcttcttacatttatcctctgactattgtttccttttgttccagcaacagctggaaatggtaaatttgtgttttgagccaatgttttcctttgccctggcatttctaaacatttattttcctacaatccaaaagtaccagcaaagaaggcttttggaaagatcatcatcccggtggctgcccatcgccctccgaggctgtccctttaaatgaggcccccagagttcactttctgaagttcattagcttgtgttatcaataatttaggataatactccggtagagcctgagtgcctggcccgccccattttcactgtcagttttctcatagcctagcagtccagtgaacttgataagtgtcccatcatcctgttaatcaaattacttatgaactaaaattgacagttttcattaattataaaggattattctaattgcaattcaaatttattcatttagaacagacggcattcagtaatatttcaggaaatttgcatattaaatggagagggtcgtccattaagtatggtaatgtatgcatatttccttatttttaacttctaggccatatgcactgctgctacttcagcaggtgaaaaaccagaacgtgcttaatttgttcaacaaacaccggggccagagcacatcttttggcactcggtactggcatccttctacctttattccttctgcctttcctttccccacctcctaccgccccacacacagccaaaaccgtggttgatctttcgaagaaacttttttgataaacctgggcatttccccccctccttttctttttcttaaatgtaggcacagctggtaagggttgattgaaatgttttgccatagaagctgtgttcattaatttcttcaagatgctgaagtaggcattaaggttgccggctggagtccttccctgtgacatgtggaacagcaaggggcctaatagtcagccttgtaacatcaactggttacccccctcgtgcggcatgaacctttcccctccagtgaaaaatgaacctgtctgagacaaaagcacaaaccacgcatgcaatgagacagtgccattattcacacccatataggctgttttcagagatcattaaaaatcatatctccatgatattaataagcaccttccctgatccaggtctcgggtaacaggaaggtatatttagcactgcccccaccacctacctaatctgagatcatgaatctgggaggaaaaaaaatgcatgtaagatgaaggttaacaagctggtgtggtaggagccacttggctttttaaacagctggtgtgtcccagctctccctacaccaggccaagtggagaaagacagggtgtggccccaccacatcaggttgtttctgatgacttttgcctctactcctcagaaattattgatatctggtcttaatgatctgaagaaagcatctgccagctcattcatctccaaaaactcacactgaataactggttgctcatttaacctggtttcaagtagacttgtttttcattttctgcagttaaactaaaggctttgttgttttacgtacagatattttatttgcggagcatatttatttcagtctgttggtataatactcgcgctctcatggccatatgttattgattgaaaagcctccacgaactcgaattctgaataggcactgtatccttggtaggtgtccgagaggcagagatggagggcctgctccctgccttgccaaacccataccgagggccctttccactgccctccctcctcccaagcaatacataaatcacaactggtgcagagcccagttaatgcttcagttgtttacacaacctctccccaaatctcagtgggagcatgcagtacccagctttctcctttttggggtacagccatttctgctggaatcactaggatcgagaaagcagaccaccaaaggctatttctgaaaacactgatggaaaattctcagaaatcattcaagcccactgacgtgtgttaagtcaagtgaaatgtccccctgtggaacgtcttttcctccacttagttcagctttagaaccatgaagccctggtcttaatcctatttctgatgtgagttaattttcaatgcaagttttaaaaaatttaatttcactgattactttgacatgcaatagtaaagtaatataaaagaatgccacaaatgattaaagtaaaacttaacaacatacgcattttaaaaatcccagaactctatttttgttatgggaaatattaagttgcataatgtgacccagcggtacaggataattgcttaagaagctgtattgtacagatattttgtatattatatcctcatgtgcagtatttctggtgatgaattcctctgcagaaaaaggccctcttgaatggatgttgattatatcagaatgtgcaccaaaagtgatgccaggaatagaaggtggtcctggataggcaggcatcctctggaaatgttgaggacaatatctcaggaattgcctttgcggtcagcatctatactacctgcaagaataactactagaacctttttcatgtgctacatctttttttttcttgaggctgatagagagtaggaaggacaggaatacaagtgatgtataaaacatggcacagagctaatgaggtggaattaggcatagtggagggaactaacctctctgagccccatttattatatctgcaaagtggagctaacatttgccctatcttcttcatggggttgttgtgaagatcctctgagacccatctgttttccaaattctcctgttcgtcagaatcgcctgagagtagttaaaatacacatctccaggcccttgtaccaagggattctagttcagtaggcctggggtgaggcttgagaatctgtattcttaaatattctcaggtgatttttatgatccagcaaatttagaagggacgggtacaccgtatgttaagtgctctccaagatacagtactcttaggaattaagaggcttgcacaagaagtaattagaaagtagttcaagactgcacctatgcatatcactccattttaaattgggcaaagctctggattataggaattctaagcatccactacattctggaacttgaactttggtgggtaagtccctgggatccgtaggtgaaactaatggctatgtgaaatttgcaatgtttgtgcagaaatgggaatctttgtgtccaccaggaggatccatgaggaagggcccttactctcctaagacatgtgcagcccacactacttagatgagccctgagtcaatagcaggtgcttatcaaccaaatatctaggtcattctgtgaatgttctttatagttaaatagactctggaggtgaaactgtcattactcacccactaaagaaatgaacttggagaaatggaagagagagcagtttcttgtctgtgaaagcacatggaaatggtgatagagatcaggtatggctgtatttatgaatcattattgatgcagaaccacttcataccatgtcagagaagaataaattggataacaatgggatgacagcatcatctaatctaatgttagtgtgacttaatagttacattttagctgccaagtagggcatgtggagtgggtgctgagattctcagctcacagtggttctagccaaggatcataacaggagtggtgggtatactctcctactcaaggaatcccattccagggcaaggtgaaatggggtgagtaaggcttttaagagatgatgattattatgttcctactgtatgctgtcgtagcagaaaatgccctgttgtctgtttgcagtggtaatggattatagcttggctttagatgagatggaaaagaaaaatgggtcttcatttcttcccctctccaccctgaggatgatagatgattaaaaacaaaacaaaactaaaaaaaaacccctctatcctcatgagacattttttgttaattgtctctttgtagctagtgtagctagctgtaaccagccgggctggttagtgatagaagtaaacagtcatgtctctgacctctgagggctgacagctgtagttagtgatactgagttagtcataaagctcacagaggtaaatgagcaagccttgaatgttgaaagagtacgctgaagaaggtctaagcattttgtacaaaatgggtgttacatttagttttagtattcagcgatttcatgaaaggaaggagatttgcagaggttccctgttcagataggcgactcgttgagggaagttttctagtagctgctgcaatttcagaagtgtgttccatgactgaagagatagaaaggagactatggtacatggggaaggaaattctctctgctgggctctcggtactctcccctgactgccttgctcccctgcaaggcatacacacactgctttaaaatataggggatttatttttcttgtgaatgtgaaacactgaatcagcaggtgctaattggaaatagagttttgtggactactcaaggacagcagtgtttccctttggggccacaaactggactttataatttcctattgaatcactgcaacaggcttcagccagcctttgtttaaggggtgtcctaatactttccaagatcctgcaccaattattgtgtacatctggagaagacagggctcacaatctccaggtttttccataaaccataaaacctatttgttctgagaaatacttaaagattggggaaaaaattactaggtatttctgagattagtctgagggcatacatcaattaattttttattgagcaaagaaaatcacatctacataaaatatgtagtttaaaaaaatcatctttgctacagagattcaacatactggttctttagtataggatctaatttcaccaaagtaattgaatctcacagttctctgaaacattttcaaagatagaggtgtgtttaggatttaatggtgacccaccttcttcagcatatccatatgctggtttacttccacgaatttctaagtaccattaatggaaattgaatgtgcctttctctaagggaaatattaacagaaagttatgcttttgtgagaagggcattttaataatttgattctggtaccatctttttcatccttggaagaaccacagcttggtgggtggccaccctgtttctgataggaacagtgagtttccattttacagattgggacactgaggaccagaggacaaataaatcatttttggctagcattggagtcagtaacaaaaatgtcagacaaattccatagctcaatgaggatgacaatgtctcttcatttcaaatgtatgcagttgggaaattaggaaataatacatctgattgtattaaaaatgctaaaatctgctcttctagttccagctctgttctttcccctgcatttttttttttttttttttttttttttttttttttatagacagagtctcgttctgtcaccaggctggagtgcagtggcgcaatctcggctcactgcaacctctgcttccctggttcaacctctgcctccctggttcgagtgattctcctgcctcagcctcctgaatagctgggattaaaggcctgtgccaccacgtccagctaatttttgtatgtttagtagagacagggttttactatgttggccaggatggtctcgatctcctgaccttgtgatcctcccgcctcggcctcccaaagtgctgggattacaggtgtcagccaccgcacccggcctcccctccttcttgacctgatctgtaactgtaagaactctcataatggccagtgcccctgtcttggagagtgttctgttagaagaggggtaaattcttcctgagccaaccaatgatcagtcatgcctggcagcatgagttttgattccccttaattaagtatgtataacttcaaatgatcctaatggtgacacaattatctggtcctctttaatatgcgaccagggttcttggtcctctagttaacatgggttatttttaaacataagcccttattgtttggcatttgtttctgtgtcttctaaaccaaaccaaaccaaaccagccaaacagaacccctctccaaaaaacccccaccaaaatccaaacagacaaaccaacaaaaaccaccagcaccaccatcctaacctgagtatatgttgccgttccaccagagaaggaatgcaaacactcagtgcagtttgtaacaccttcgtgcatttcacatctcacatttctgttctttctttctttttctttctgttttctttttttttttctgctgcccatgagtttcattttcccatgtgccgttatattaatgtttttccctgctggcttcccagcccgggggtcacagcttgtgtttcacaacacaagacacccaaccataaatctcctttaaataatacagacggcaggaggggcactgttgagagccagtcggtctgaacaaagtggcattgatgcatggcaagcggagcagcttgaccacagcccggctggacaggtagagtgtggagcagcctttattcaaggggaggaaggcatgtgctctgcatggctccaaagagccaacccgtcctggttctcagtatgagttggctgccaatcaccgaggtttccagagaataatcacgccacctcttcctggctccagttggaacacccaattaacataatttgtgtttggaggtgcaaacgcatctcctccattataaatctacatttcttgaggcctcttggccatatttaaaatgaggttgggaactgtcagggtggaagtaacaatacacacttgatcagaatacatgatgcattgtgacgaggctgtttccttattctaaaacctagagtggttaatttaaggggcctggaaaaaaagcttgattggagttaatgggagccttgcttgcaaaggagcttgctaagatgggaaaggaaaaagatgagggtttacctagggatttgttagcacaaacaaaaattataacaacttattgacacccctcagccaagatatcatgttaagttaatttatctgtggcaataccttttgtgaacaaagatatgtgcaaatctatgtagacatacatagagatgatgtggacaaggtatacaaagatatttagtttgtgcacaaagataaaaaatgcatgtatgggtgtgtacaccctccccaacagtttgggaaataattgtcaagcacagcaggtactgtgtattttaagtaaagatgaggatatagtgagaggagccacaaagtttctttcgactgacaagtcttttcaggatttatgccttgctcatcagttgccaaactccagctcagtaatttttgtctgccaaaactcggtggtggggtgttggggagaagattagcatctcatttggttaattttttttggactcctttttctacagctattagttacacttctgaaaagtcaacacagcttctaatttctcgattacttaactcattgtagtggtgtcgggagcagttttcattgaagtgatttctagaagctactgcatacttgataaatgcgctgagaacaaaagagagaacactaatgcagggaatgattgtgctggttttggttggttacacctttgagcatttgttttttttttatattgttgacattaattgctactgtaatgtaataattgcttcaaagatacatgttttgggtggtgatagtagtgaaagaggagaactgattctgttcttattcatttaaaataacaaatgaaactgataactcaggaattcatttcatgggaccaggacacccatgagaataggaaggttttggtaacatattaacatcccaaactgaaagttttgcttttccagcttaacgtggttttatatggggcatctcagtgatgagttaatgtgttatagaattaccctagatgttaattgggtatctagcaatatgctaagatacacacctattttctcagatttgcaagccatgggtgtaattttggccttatcttttttccacctcatccataaatgtaggttttcaattatttgaaaaaactttgtttctgattttatttgttttggtggctttttagagctaagaacaccatactaatgccaccctgtgagtatgtggtattgctgtgcacaatacttccctccttgtcaccttcgctccactgtttttctgtctgggtccccattagagtgactgctgcatgaaggcagagatgatgtctgtttcagaaactatcatactcccagtatctagccataattacttttagtctgaccaacttccctgatttgcctggggactttcctggttttagaactgagttccaaccccaggatgtcccccagtcctagactatctgggcacataggtgctcatcaatattttctgagtaaatgaacccctcttcgtaaggaggttacagagttatgtgggacaaaagtgaactcaacttctatttgaaattagtcagcatcatatatgtacatcttatctccctggtcaacaataaaggatgtgagagcagggactgtgtctcctccatttctttgaatttttcacagtgcgctagtaaacatttcaagatagaattcaatcaagagctaaatgcaatagaaccaaagagcaaattgttctgtggtataaacccagactctactccttcctggctctgtgaggttgggcaagttactcaatgtctctgtcatctttttccattatcatcatgtgtaaaatgggaataataatagtacctgcctcacagaggtggtgtcaaaattcagtaagaccaagtacagagcacagcctctgcttcgtggtgagtatgagacgtgtgtaagctattcctcctcctcccctgcacctgcctgttccttctccacacataataaacactgagcatgttcaggtaagtgacagcacctttttgttgttacatctcattaaactgaattttgagttgtttttgtatagaatggtttgcctggaaaaaggatgctttttttgtatgtatgattggttccgaaatgtctcattcattttacctggagtctctttgctttttttttttttttttttctgcattgccagggtaaggaaagacaggcagcctacttccaagcaagtgatctgttataggtgggatagtgaaactgtcacttacaacattcttgtagagaatgaacacaagacaacactcatactggcaaagagagaagctttgaggggaggtgtgtgatatattgagtctacctttatccctctttccctatcgaaccaccttcccctcatggtaaagctgggacctaggtatattggtggcaacatttctctgctgctgacctcaaagagactaaaagcatacgtgattgaaatgaaaaataaatgagcagctatttataaataactcctgttaacgaaggcatgtgtttcatggaaataatctcatacaaatgactgctttattttgctccctcctccattcccttgtatccctcctgctacccactaagtggggccagggcaaggctttccttacaggtcccctattttcttaatttttctggtggcaagcagcagaacagagtggtgtcactgggttgcctttagaactttagtcattaaatctcctttgccccagcttcggtgatgcatatttcaataatgagcaagaaaaaatggtttatggtagtttaataaaagcagaagacaaatgttgctcctgtgcaaaggaactgaattacatacttcatgaaccaaattagtaccaaaacatttggctttgttcgaaaggtaatatgcatttatgggcccatttttcagtaagataaatatgacacacgccaagatttccctgaagtaaatactgtaaataataaaagactctgccaaggaaagctgagaaatgacttaatcctcatccagtgctatcgcaatgccaaaatgccactgtccagacttgagaacaaactgcctctttaataaactcatctcatgatcaagagagtgcaaggccctttaatttcccaataatggtcaatattcctcaattccggcttaaaaaaaatacattcacataggagctagggcattttatggcataagcaaatttgattaccaagtaacaaaatacattttgaggatggttgggagttacacggcagcaatgtttatgtgaataggtgcaaatgggggaggtttttgcagaaagttaaagctatcactcttagcctaactctataatcctcatttcgcttgagcttattccagttaaagttttctgctagcaaaatgtgctgaatgtatttcttccctgggtgcagatttgcctgtgagaagctgggatgataaacagaatgctgtgagatgtgaataatatgagaattcacagtgccagcaagtgccttctttaaagtcattcagctggctctagaagatgttacaacacacttcttgtagtagggcacattgttgtcttaatgctggagaataacaaattgaaatgccacctgagcaggcagtaatataaatgaaccgaggaggtgagatttgagaaatgtattagggagtggtggggactggggcagaccggcgagcatgtgccttgtataaaggggaagtcaccaatataccaggtcccagctttaccataagaggaaggcggttctgtagggagagaggggtaaaggtagactcagtgggcctttagaaatgggcccataaatggatattacctttcgaaaaaagtcaaattcagttcctttctaatttcggttcccaactaatagctgctatgcaggaatgtggacctagtattgctggatgttttattttcacaaaatgtgggatatcttgatgtttcagtgaatgctcccaattagtaaatgctgacaataaaaccagaaaggctctgtatcccaaataaaacaaaggtcatgggcttagagtttgtgaattgtgctttgaagttttgggcttgcaacacaagaaaacaagtaggctgtaatgaatggcatttagtcctgaggcagaggcaaaggtggcagcacacgtggctgggaacttgctgtctgctgggatctgtcctaagctccaggtgcatcaactcattggatcttcaggtccccctctcaagcaggcactgtgagtaggtactatttcttctctgttttatagatgtggaaattgaggctccagaaggcacaggcagaatttgaactcagattggctctgtgagctctgaggcaccactcaagcattccttccccttgctttggtggtgtggcaccacaggaagtaatgtgaattggagtcagggccttgggtttggttttgcagctccccactccttcttgtcttttaccctgagcctctacttcttgctggatcaagtgttttgtaccctccaccccctagattaccgggtcttttactctgagcctctacttctccttgtatcaagtggacatgatagtacctgcccactttacctcacggggtggggaaggattacctcaggaatataagcagaagagtgtggaaaattgtaaagtgctctgtcaacacaaggagaaggaatattgctcataattagagaatacagagaggtgagatagtaaagccactgattgtctttggatcaaatacaattaaatagcaatcccttcttgactcttcaactcaataaagtgtctatttgtagaagtggctaaaactgaattcactttgaaaattaatcagccaccaccaatggctggattagcagactgcgttttttttttaagtgaaaaagaacatagcagataaagaaatctaccttccaaacagaagttaacagcctaagacctgcccattgtctgccaggctcttgacaggaggacagagcatgagggcaccccactgctggtgccttctgtaacccctaatcaagggacttcccttaggagaagccagagagaagagaggggccattgctgacctgatttggaactattaattgaagttggctgataagggcacgttcctgacccagacacggtgagcatttgaagagaaaaagaaaaaaaggggcatgcagaaaacatttatggaaaataccccaagaatgatgcagaaagctgtttatgcatgtaggcagtgagtaatcttcttatttacaaatgaatgagctgacccggggaaggggagctttgtggattataatcacaatccaatgcgacaggcttcttcgctgaagagctctcccctcattgacagccaaagccttgcagaatttttccccctttatactggagtctcaacctaatggcagtgctaatttgtcctccaaagtttcgtgaactgaaggtcttagttattttagtttacaagatctactttaaggaaaatcttttgtgcctgctagatgttgttcttaactttccagctttcccttctccactttccccagagccgtcctttggctctacccagcaaagtctctaaccgcacctgtcaaagaacctttcctgtctctgggcttggattggacacccccagttagaacccttgcctgctcttttctatccacagctttgtgtccttggccaccatgctgaaatctgttgtccccatacgagaagccttttgggctgggctctgtggctcacacctgtaatctcagcactttgagaggctgatatgggaggatcccttgagaccaggagtttggaccagcttgggcaacatagagagaccttgtctctaataataataataataatgataataataataataataataataaaattattcaggtgtggtggtgcatgcctgtagtcctagatacttgggaggctgaggcaggaagattgcttgatccctgagttcaaggctgcagtgagctatgattgcaccactgcaactgcattgcagcctgggacacagagcaagatcctatttctagaagaaaaaaaaaaaaagaaaaagaagcaggcttttgggcctaatcgtactttgatcatgccatgaatcaagtcagcttgtgacttgggcatggagtttcatcaatactcttgctcagtaattgataggtaattattttgagggtggagttttgattgcattgtgtggttgtgtctctacagcctcatgggagacattgttattagcttcctaagaatttcctctccttctcgacagcagtaaaaaaatacataaacaagcacttcttactctcagtagatgggaagcagtatactgtcaagttaggagcatcagaaaacttctgttttgtttttttgttttttgagatggagtcttgctctgtcgtgcccaggctggagtgcagtgttgcaatcttggctcactgcaacctccgcccccctggttcaagtgattctcctgcctcagcctcctgagtagctgagactacaggtgcatgccaccaaacccagctaatttttgtatttttagtagagacagggttgtaccatgttggtcaggctggtctcgaacccctggcctcaagtgatccacctgccttggcttcccaaagtgctggtattacaggcgtgagccaccacaccaggccgaaaacttggttttgagtcttctcttcactactcactctctgtgtaaaccgggggaagttactgcattctctatacctcccttttcatatctctaaaaagggggttaaaagaatacctacttcatataactaacatatgcctagcatataccccaaatatttcttggtaagctcttaataaatgttagctataattattattatggaaaatgcttgttgactaactgaacttatcgccaaatacttttgctgttgcaaaatagtgctcacatagtgttggatgttgaatgaagaatgaaaaaaatgattgaatgagggaatgaatgaaccagaaggcacagatatattcattcatttattgttgactacccattgagtggcagctgaggatgtagccaagaacaagacaaacactatccctgctgtcatggacttcaagcccagagaaggcagacaaataataggaaaattaaataaataattaaggcaatttttcagacagcaagctttagcggtgcttggtgaacatgaggacaattacagagaactaatggtatttatcctactgtcaacccaatggagaaagtaggttcaaatgtctgataagatgtatgagagagagaaagaattgttctatgttattccaaagagcaagaataacatccatgtggtagaagttaacaaggaagatgattttaactctggctaatgaagatacttctggctcaatagtccaggagtagactgactgccttgagggcagtgagttcattatcaaaagaagagcataaacagaatctgagggacattcttgagtaatatgtaaggttgctttggataatctctaaggttttttgtagagtaaagattctaggatttgctgttctccaattgactaatgaagagatctcttaggctttgggataagagagaccacgtttcaagtctaattattaatactatctgcgggaccttacttatttccactttactttcctcttctgtagaatgggtagacttatttggaatgcggtaaggattacattaactgaggcttgtaaagtacctagtgtaacgcctggtgcccaataaatggcagttgctgttgcagttgatatttttatgatcattgttattagcatcaaaatttgggaatagctgtcttagttctctgcttcaggggatcctccctgctgaggcagtgactagggagcaagtcaaggaagtagttaggggtcagtgggaaacaggtggtagctgccttgttgaaaaaaacagagttgtacaaatgctatcaatttccgggcctcatgcccatgtcgttaccaaatcagaactgcctagagagaaagagccctcctccatctccgatgacagttcttttatcatttttccctcttctgagctacctttagtgttaatcaaaatttgatttcattaggaaggaaaaagtagtaaaaagtgatagaggagtggagacacagtataatttgttttgcaccctccactcccctctcccaccgcccaggtctccagggagatggccttgaagatacattcacatatgcctcttggatccaggcatctttgtaaaatataaccccagagggaaaaacacaagaacatcttcttagataagaacgtgccaattcttctggttcaaaatgtcttcacgtgaaaaatttcctgcagcggtaggaggaagctcacacacaggacaagcatgagacacatctggagggagcccaagccgggaacccgagggcctgaccatctgccagagggccagatgctgctgctggaagcctcttgcctcccagcttgtcatctgggttcgatgatgccatccaaaagagggccacagagtgggagggcgatgagcaatccatcttctcccacccacggttcttaattgtgtgatgtagggggtggtaggaagagaagagggttaaaaagtttgcccacaaaaccgcacctttctcatggaaatggccatcctaaaacacatggctctgaccacccagaacttttagaatattccattcaatatctcttcattttccttcggtctaaatagaatggatgaagaggcttggctgtgtagttgtcagtgggagctgccatcttctgtcaacttgggagtgtattaagagtttctaaccaattgcattggtcgttacattataggatttcctatattgcaagtgttcttcccgttaacagctttggtgtctgattttggccaaagcagatcattgggattcagagggacatcctcttctttttccattgcagaaacaatcaagagtctgtgcacacggcactcataaaaggaaaatgatcaaaaccacacacacaaaaagactattaaattccagatgagattactgcttcctgtgattcccaccattcgggaatgcctttctgcttcgtgattgcccactgacagacttacacaagcaagatgtaaacatagtaggattatctcttacactatcacatatgttttatgctaaatcattagacatctaggatggttttagccatggcctgttttcagtgccagtggtggtatatttttgtactagtgtacgtgctttaactcacaagtaattgcaatattttctaggcatatgcaaggcagaaactgttttattttaaaatggcacctgttggaatagtttaatatgtaattttcattttcacgtaattattcagatacattattgaataacttacgcatcttgtattcaacaatatggggaacagtatactgtgtgtctacagtcttgggctgctgatagttcctctgcattcattagaggaatgactggggcatcttgggctgaaaccttgttatcgctgctctttgtaagcaggttgtgttgtcactgtagggagggagggctgttttaagcttcgttcccacatttctttttgcagggctggtaggaccaccacctcaggcagtctttcactgccctgtaacgtggatccttcctaaatcttcactgttggattgtgtggcaacttctgcctattagagttgcatctgcaataaaaaagcgaggttcctgagagacaaaaaagataatcccccgcttagtgcgtggatgacagccacactgagtgcagtactaccagtggaaagtctgaggttttgaaaatagcagaagtgaaggaaatgaaaatgtgatgtgaatttatacccaacaattgttttctatatttctcaggctaacaaatgtcccagttagaaaaacctctggtactgggtagtttggaaaaataaaagttgcattgcaaaaataaaaagaaagatcccattctaaggttagagcaaatgtttgaaggtggatagaacttccgattctggttggtggtttattacatatgcttcagggacttgggcacatttgactacaatgagtaatttctgagaaaggatagtgagggagaagaacttttctgtcagcgtcagaaattcttaagtctgatgtcaaatgattagtaatgatgtggaacagttgccaatgcaaatattggtaaaaggagagcacctggagatatcaaaaaagaccaggggctattcagacccaagatagatgtctctggtcttcagtagctaagtatatatactataataacagtgctgcttttgatatttaaaaaaaatgttttaaagacaaagggtaaacttaaaagtcatggttcttaaatagcaagagattagggtcttctggggaacaaaactccaacaaaagattcccttttacacagttttagaatcagcaatgatctttcaatggcaaatagtgatggccagcatttgttgagccctctagatgcctcgcccagtaccctttgtgcattgtctcatttcctcctcacagcagtccagtggaggtagtattaatatccccattttccactgtcaaagctcacaccactcttcactgttggagacaagacataattctccatttccaaactaatcatcttataaaaggaagaaaaagtgacttcaccaaaacagctgtgggggcagtggcacaacttgaacttgaagctaagtcttgtggctctttttgccattggatggtggcttctatgaaattctgttgcttgtggttaattagtatcatcaacttgcacagttcatttcttagtcacatatgcatgttaactgtccctttcaactagatgagagcaagaatgatttttttttttaacgtttaagttcagggccacatgtgcaggatgtgcaggtttgttatataggtaaacgtgtgtcatgggggtttgttgtacagattatttcatcatccaggtattaagcctagtacccattagttatttttcctcatcctctccctcctccaaccctccaccctctagaaggccctagtgtgtgttgtttccctctatgtgtccatgtgttctcatcatttagcttccacttgtaagtgagaacatgcagtatttggttttctgttttgtgttagtttgctaaggataatggcctccagctccatccatgtcccgcaaaggacatgatctctttctttttatagctgcatagtattccatggtgtgtatgtaccacattttctttatccagtctatcactgatgggcatttgggttgattccatgtctttgttattgcgaatagtgctgcatgaacatacacgttcatatatgtctttataatagaatgagagcaagaatgatttcagttgccctgcagtaatactaagggtctaatagacccttaacaaatatgaactggctgtcaaaatgcctctgtgttcggtgtgtcttgggctgaaatcaagggacccaaattctacctccattactatttagctataagaactgggcacatctctgaaactctgtttgtgccactgggataggataggtgggtgggcaggggtaggggcaaccagtttttttttctgatcttccaaggagagaaatgaaatatcaaaagtggaaattctttgggtatttattttacaagaggttttaaagagctattggagtcatttggcctacagagacaattttaatggagtaatgaaagaagatggtgagatcctggagaataaagcaaccacccacgtgactttatcctatgtgtgtaaatatgcacaacacatatgtacaacatcagagaaacaagaactttgaaatcatacaatttgagtcccagcctttgccacttagctgtgtggtcttgagcaagttacttaagctttgatttttttcatcaggaagttgtgggtaataatattcccctaaaacaagattaaattagagaattatgaaaaacagtcagcatgtagtacattacaggtcttcagaaatggtagcgattactattattgaatgaaccatttattgagtgtttaatctttcagaaacgtgtataaaggagatacaagaaaagaaatgggcaaagcttgtgccctctggagattacaatttaataggtaatagttgaggaaaaaaaactcaacttcccatcaatatagcaaatcttattcaacagtggataattaaatggaaattctgtgatccgttctgcacatcgaatggtaccgtattccttgaaagctctttatcctcaagtgattaaggaatattttattttgattgaaagtgatttgaaacttgccttctgtgaagggttaacaatccatattattatttctttcttttattgactttgtagctaaagaacctttccttgttcaacctgactttgcctttaatttttctcttccttgttatctgttgtatacagtaattgggaattcctttcctttccatcttttaaccactcctcttctttgcctctctctttgtgctgaatcaagaatgcatttcaggagaagaaatgtttgtatatgtcaatagttccaaaagtatgatttggctgatctcaggagttttatttttagaacttggaagttgagttgcatttcagcagctggttggaaaacaagcttcagatatgtttacaggctgggagcagtttccacttctgcctcaagggatcactggttaggtagttcaggctaccaggcttcagaatctcctttggccaggtcactcctcctgatctgaattgcttaccattctcctctcaggaagtatttggtttattgatggtgtcccagtagaatgatagcattgtctttagtcactgacctgggcagggcagatgactttccttctttctggcccagcctcttgtctgtagattatgcataatatttggcatcgattattgtgaccattaaatgagataatacatgtagaatgcttaggacgtatagtaagtactctgtaaatgtccactgatattagtattaactttattttcatcacgatttttattatagaatagccaaacaaatattatcgttacaattttattttgagacagggcctcgctatgttgccaggctggcttcaaattcctaggctcaagcaatccatctgctgttgaacctggctaaatgttatttttttactgcgtttttattctttttcaaagtgctgtactgagtactctgtgcataatgaatgctcaatgaatagtgctggtgtccaacatttcctacctggcatctgacttattattgatgttcatagtcctacaagggaaaatgatcatctgttctcctcagctggtaaataaatttggacaatggtaaataaatttggacaagattcttatagactgaaattgattttggcattcattataatctttgtcctatttaatgttcatatttatatatttcactgatgggttgttacataatatacagtatatatagtatatgtaacattaactttctaaaatctaaagggttctgcattctgaaacatacctggcttcttaaaggaaaccagataagggactgttggcttagagatgtgggcgaattgatactttataaagcttttctgtgcactggcccatctgattgttgtaaaagcccattgaaatcagcagggcaagcatgagtcccattttacagataaggaaatggaaacacagggacgttggattacctgtccaggtgacacagtaaatggccaagttcctatatttcttctgccacacttcctgctcttctctgtgatgttgaaagagcaactaatcttgcctgtaaaacaacgaggaggtgatatctggtttgagttttgaaggatgggtcactctacatgccgcaagtaattgggacctttttagcatcatggaaactaatctgccacttgatggaacttaacccagggtagtttcaggagtatgagtaaaaaagggggagaaaaataaacctgaaaaggataaagacatatttaggcattaaaagattttactttttatttatctgccttctattttttattttctcatgtttgtgcatagagaggatttttaagaaccaaagaaaaaaaattcaatggcctcttccctaactcaagcttgaaaaaagatccaaaatagatttgattcaaagaataatattgtcccattattaaattttggtatcagaaatgcatagagaaatttaatgattatttcatgatgcaatcaatactctgtggactctgccatgtttgctgggaacttggaagtgacattttaaaggatatgttaattttttattttagtgacctttttttccttcattcatttgcaggagttttagtatttgggccagaactgcttaaaacatattttaaataaagcttctcaacctcacttccctccttttttaatgatgtaatctttgatcattttaaatgttttaacagagctctttaaagaacaccaaatctttgtaagatttctcagataacattgtcctacacctggaacacaagaaccattttgaaactgtaatttggtccccgaagagcccttcagcctcttccctgcttgcttgccctgactggactgtctagaaagaaagctgaagataaatggggctggatttatgcagagtaacttaaagtctcctgcctcttcttgtctgtcttgtggagaatatacttggaaatgtgttttaagtttgaagcatcccttgaacacctattttgtgattttgttttcttcctttctcttcgtggaacctttattagaagactgacgagccttggcctcagcaaaggattaagtgagcagattcttcatgtaataaatctaaagacatattaaaagcaaggaaaagggatttcccctgtgttttggggggatttataagtgccaaaggctaaacaacttacaagagaagtaagattgcccctttttctaacctggacatgttctaatattgtgacatagcgtagaattaagctggcttactaagtagaaacatgtaacataattgaaaatgcacaatacagagaggaattctcgatacagcaatgtcctgttgtgaagattacactgatttataaggaatgccttaactcctaatcccagccatgcaagactacagagtcaagttgagtattttataaccaggggaagagaaaaaaggcttaataatatatattcccaaaattgaatataaatttggaactgatggttgagcaagccattcatttctcttaaaacaatgtaacaatgaaaacatttttattacattttgacatgtggattttcaaagaagttcaggcattctctatttcagaaatgatgggtatagccaaatcagagagtgagtaatggaaatgaatggtgtgtgagggagaaggataaatattgtgggacataaactgtttaaaaagatcagcaaagaagaaacgtgtcaggctagcagaaatgaagccaaaggaataaccttatgtataaagtaagggttagaaaaaaaatcaaagtaaaaggggcgcttcgagtaggtgctgagtgagcaaaatcattatggcttgaaattaaaaataataaaaaataagaatagaaattgagtgcaccacttctttctttttttgtaaaatgtcttaccaggaaaagtcatatcatgaggtctgctcaggatggagaattttaagagcttgtttatgcatcaaagatatcatggggattgtacccatgtctaagttcaaaatatattttatgtatatatgtcttaaacttatagcctaaaggcaattttatacaatatattagataattttgtgcatgaaacgaagttttgactgcgaccccatcgcatgaggccaggagtggaattttccacttgtgtcatgttggcacttaagctcatattttggagcattttggatttgagatctttggttttttttgtttcgtcatccaggctggaatgcagtagcacaatcttggctccctgaagcctccgcctcccgggttcaagcaattctcctccctcagcttcccgagtagctggggttacaggtgtgcaccaccacaaccggctagtttttgtatttttagtagagatggagtttcaccatgttggttaggctggtctcaaactcctgatctcaagtgatccgcctgcctcagcctcctaaagtgatgggattacaggcataagccactgtgcctggcctcagatttttggattagggatgcttaacctgtatataacggtggaagagtaaaatattgttgaatagaatattaaacttaggaaggactataaatatgtgtgtgtatgtgtatgtgtgtgtgtgtgcatataggaataaaatgaagggaaatatctttggaagatagtattccctggtatgttacacaatcacagcaattgtggatgaaatccataaaggctatgttgactgtgcatatagaacaaggggagctcttaggtgaatggtaactcattggcaaaaataaataaataaataaatattttttaaaaataaagacaatattgagctttgcatcatttgtttgtcagtgagaccagaagaataaaaactgaaataccaaaagaaatttctagttcataggaactggaaaactatagagtaagagagagttgaacattcaaaaccttgccaaggagacttaactgagccaagaaatggctaaatattgtgtgtgtctacagcacacacatacgtatgcgtaaacatacctatgtaatttacaatttacacacatatatacacatagacatacacacacacacatatatatgcatatacactagctggctctaagaaggaaaattaccagagaaataaagattagcccaaagttgagacctgggaaagtgatggctctggaaatggccagactttagcactgggtctacttcgaatccaaaggaaataacaggggagagatgctggagagatttattttttgcttgcagggaagtgggcattaggggaaaaatacacatatatatcaataaaaagggaagaggattttgttaccataagagaaggatgagcttcttcctacagttacagggacacagttcccactgaaatcaattttcgttgctcagagaccactgcacttagttttctaactgcagaagttggctacatacagaaatgatgtcttgaagccaaaagaaggcagtggcaagagagagacatagggttttaaaaatgccaacctctcaaatcagaaagcattgttgtgctcaaactaaaacaaacaaacacacacaaaactaaattatgtaccgtgggaaatcgtgaacttcaatacctcctcacttcaggataacctgtgattcttttgtggaagacagagtaacataccagtttcacttgtggattaacttcctgagtggacagaaaatctgtcttatgctcaacagtcaagttgttttatttatctttgatgtttcaggcaaggggaagaaaacaaatagtttccataataaggtagacactagcccaggatgcagtaaagcatttcctgaggacttggctaaaaggaggtagaactaataccatcaaagctgattgagttttattttaaaatgttaaatagaaaacctacactttcaaaagtgatccattcccaagtaaagggaaaatgacatcatctcaacttcagtatataaaactcttgtatatttgataccaggcttagcagcagggtggcgggggcttcggggaaggaccaaaaacaaaggcagcagacaaaatgaaaagtataaatagaagtattgaatatacagtaacctggaggaaattactctaatgctgctctcagttcttgtctccatttgtaacaatgagaaagaaatgactgaggtatgtaagataatgctataggagtcccatggttcagacaggaaaaaggtctgtgtctttagaaaagaaaattaaaagattaatggagctcgttgagaagtttgcatggttctgagaggcatgtagaagtggctggtggctatttgttttggaattaaatatatgaggataagggctgttaaatgaataagcaaatgcggatcatctttgacattctttgtaggaaagcataattaccacattgaataaaggcctagtggccagacagcaggaattaaacatttttaaaaaattaagtaagtgtaacatttagggaaaaaactcttaaaatatccctgtgtgacagttttagctttgcacaatttttttatatctagcatatatattttcattttacgcattctcacaacaacctaggggattagacaggaggatattattatagttgtccttccgtatctgtgggggattggatccagcatgcccccttggataacaaaatctgcagatgctcaaatcctttatataaaatgtcataatatttgcatataacctaggcatattctcccgtatactttaatctctatattacttaaaatacccaaatcaatgtaaatgctatgtgaattgttgccatactgtatttttaaacatttattttattttcgtatcattgtttattgtttgaatatctttgatttgtggttggttgaatctgtggatgtgaaaccccatagataaggaggaccaactgcagaagaggagtagagaagacctagatgttggctttgactctgctggtagctcattccatgacttcacacatattcccttaatccctctgggtctaatctgtaaaatggaacatctgagcaaataatttgtgaagcttttctgctctagattctagaaacctttagttgtccagtttcactaatgaattagggataacagaggctagaatcccattctcgtagctcagcatcataaataccttagatgtacttattctcaagctttctgctcagctttgccatcattgaggtttttttccttaatttttcctgtatataacattaagcagtagaggaattgctaggacttgtacaaatttatttttaaaattttaacctcaagaaacctaagtagaatgacaaagtggatcctttagctgctccaactgaaaagctggctaaatactgtcctcagcagaattttccagggtccttcttgccatatcccacttgcaagtactgtctccccatcctcaccacttgccatccccatctattgatttagatgtggtttattccacaagtacttgttgaatgcttaccataggccaggcatacagtattaggtgtttaaattagcattatagaatcctggccactttctaaatggtggagtttgaagttgtgggaaatcagggtagttttggtagtgttacaagtgttacaagtctttctcagtggggaacatatgtggggaaaaaaccctaaagtaatcagtgggaacttaatacctaaatacatggatgggatgggagcaggaaaggaagagaattattcaacatattggtgggagaagtaaagggaagaaaattctgcttgtgttgattgggagaggacacatctatgacagggaagatagcaggaggaaaatctggtgggaagatgaagaggaagaaggaggaagagaaccctaggttaatagatggagatggtggtgagtgttcctggagtggcagaggctggaggagaattgcattatgggagggatgatagggcagtagtggagatatgaaggagtaaattcatatcgagacacaaattaaacctttttggttattgtttttcccactgcagacttctcctctattcaaaatgtatcagtaccagttccatggtctttaatataatttgtcaatttttactgggatctggtggaggtatttattttaaattgaaaagatatagtcatagaaaatgttttcttgacaactcactgaacaaatttagcacattggctgtgaaagctttctgtagctatgtagatttattacttttatgactctatactaggttcacattcttgcctcttaggaatgaatgtacacaactttctctgagaacaatttggcccagttacattttattagccataatacatgctagccatagtcagtattctttctggtattttgatattaagtcagacattgattccacaatatacacacaacaaacacacacacacgcacgcacacacacacacacgaataaaaaatgaggagtgaattttaagaggctctttcatttcttcaccaactaggaaaaacggaaaaagaacttagtggtggtaactgtcaatatatgttgccttttgtggcgtctctttcctaatcaaataaataatttgtaaggttttgatgagaaaaggatgtgacttctgccgagccctcacctgccagctttactccaagcagactgatttagaggtttaagcagagaaacagtcctttctcctgtttgccctggaaacagagagccccatggtgaggttaatcatttgaattttgcaattcatattgaggcaaaacagaaatcattcttcaccttaaaccctggaaatgtgttggcaaacttttcagagctcaaggtaaggcttttccccccactctttgaatcataaacatgaatgctttaaatatattttttcataacccagtctcccactgaagtgaatcttactgggcaatagaaaatggagtagaaatcacttctagaatactgggttaaagtgaaaataaatagaggagtataaaagacgcttccaatcacagagaagcttgttgaggatgcaggtggaacctgaccgtgaaggttgtcattcacaatggtaccttgcccatatgcttttcttaagaattgtctggcaaaatgtatacattttatttaatagtatgtattattaatatttattaaatatgaaatttagttaaaactgcttctgagaaacaggacatctcagagatgagccttagcgtgaagctcactaattctaggcccaagaattttgcaacaacattacagttgttttctacaatggctgtttctgaagaaaggacgtatacattgaagccaatttttaaaatctagggtggttgatggtaaactttgtggtttatttttaggatcaaagaatttctaagttattgacaaggaaaagatgtatcttcggcttggctgttataattcagcagatgtctctgtacctgttaggttttattggccatatttttcgaatgaaaatagagacatatggtcctatatgtctaaaaaagttacgacaacagaacagaagccattcatttgctgagtcattgaaaagaaatgttaagtaccaatttgtttttgccaattggtgtgcccaaaaaagactgaatatttgaaactggggcctttgaagaatctaggtttctacatctgtggtgtcctcttctgttaatataaagtctctctttttttttgagatggagtttctctcttgttgcccaggctggagtgcaatggcacgatctcggctcattgcaacctccacctcctgggttcaagcaattctcctgcctcagcttcctgagtagctgggattacacgtgcccgccgccacacccaactagtttttgtatttgtagtagagaccgtgttggccaagctggtctcgaactcctgacctcaggtggtctgcctgccttggcctccctaagtgctgggattacaggcatgagccaccatgcccagcctaagtctccttttgtaaagaaaataatcatcccatctgtgttttgaatttaaaataagtatgcattttctcaaactggctgtacatgttgttaatctcctagtatgtaggcagcattaccttatgtaaatatctggctagaagtaaatctttgaaagagaaacagaaacatgacttactttatattagtttaagatagacagagggtttgggattggagttccatgcggtgaaaaccctcttttacccccaaatctgtacagaaatgctttaatctaaagaatgtatttgtgaatcctttggactcgaaaacaccagtgcagagcaaatgcctatctatctaacttggaatgttatacttcagaaatagcatggaatgtgtcagttattgatgaggattgctggaagacactgagcatctggcttcagaccagcttttgatttgccaatgcaaggaacgtctgttgggtttgtaaaacttgtggtttagccactggtccacacagcttttccaatgcaacattttgatgacaggcatgccttgaattatgactttgcttctaacaggctgcatagacaatagctgtatccttgtagataatctggaaggtaggaattgatggattcctctaaggattaggacagaagagttgggcaaagggagtggcacaccttcccattcacacccagcactgccagcaaggccaggctcctttcctcctcctgccttagaacaacctccttcaaactgtacttggagtgagacttgggggaagttgtagggagggcagaggcagagaagcaatttcaacaggtactttgcagaatatacctgctacatttgatcacatattttctgacatttttctatgctaggaagagaaaactgaaaacaacagagaacatcatggcagagaataatggttgacatagccttcggtgcttggcagacccaggtttgagtcctaattctgacacttggtaggatgacatttaaatgacttgcccagacattgtggaccttgtttccatatctgtaatggagccagtatctttcctgcagagtcattgttgaggatttgatgagcagaggtggacaaagtggtagtggagtgcctggcccatagcaggtgctcaataaactctgatgatatgatgatgattgtgtgggttgcttctgctccttgtaatacccctgcaatgtgtgcatgattaactgatcctctgaatatcactgaaccaatagtaccaccacccaggcagctccatcagcccaaagcaagggtgtcacccttatttagtctgtcattaactcctgaccgcattactgacttaacatttcttgcctgcgtccacttctctttctcgtgtcctctttattttccactctgacaactgtgactgtcttctcactgttcccctttccttttatgtggctccgttttaatttgtcttccacgtgacagccagagggctgcttctaaaacatcatcttctggctgaaacttttccatgtcttcccattgtcatctggatgaactttagatgcataagcaaattgcctgtgtcttcagtggtcagcctgggcttatgtctccttcctctgcatccccaaacagtcatagacctggcctcctaccacactgagctccctgcagttgcaggagtgggcctttaacctcaggcaggtgtgcttttgcacatgctgcatctgctgcctggagcaccccttctctccatttgtgagacaaatagcacagaagctctgggtatgaatgtagagttaggccacctgcatttgaatcctggatctccctctcagtagctgggtgactttgggtaaattttaatttctctgtgtctcaattcctcattttaaattatggataatactacctacttttcctgtcaataagcacaaatggatgaagagacataaattatgtaagatattttctatcatagagtaagcaattaatttaatattagtagtataataatgatgatcagtattgttcttgctgctgtttcagaattgcactcaggattaaactctgtcatgatgatttttctgacatacccccaaaggctgagttgggtgtgtctcttgcaccttcctgttgtgccctgtgttccacctaaaagcactctcacacagcattccagctgtctcttcaactttcccctgtcctgagggctaccttgcctaccttttttcatttttatgtcttcagcagtgagcatggtgcttggcaagtaattagtgctaaatagatgcttattgaatgtattattttcattttacagatgagaaaagtgagattaaaagaatttgagaggtgtattaaagtgttcacagaactccctagattcatatttctcatctacaaaagagggtataatcaagtacttgttagagtcaggaataaaccgagatctctctgactttcaactcctcatttattccactatgcctcacttactgtattttgctaagatgattctgatcaaattgaaatggatgacacttgatttagtgtcacagcagctattctgttctttgaaccaaaataagtctctgaaaatatgacaacagtgacttaagctgtcaggatagaaaaatgttagcaaataatagtattgtgccagaaactttacagggtgcagggtgtttgtgtacctgctgtaacaggttcatactagagaaaagttgctgtgtgtgttggagtgcgcagcttccctgaagacatctcggttcccaaggcagtgctgagtttgctatgtgcttcctaactttttgctgtgctgggaggtttgttagtttctgccttgttagtagtatatatggctcttataatagactgtgagctcctccagggcaaggaccgcttttttatcttcgtatcttccttggttcttcacacagtgccagagtaaaatgctttgaacagtagggaaggagacacacaggctttggcatctggtggaacccaggctcagtggcttatcagctgtgaattgagtaagctgcgtaacctgccaaagccttaacttccctacttgtaaaacggggctaactactctcataggattgtgagacttggagatggtaatgtttgtaatatcctcagcatagttcctggtgctgattcaaggctaccatctctggagcacttagcactcaagcgagcacagtgccttttagtagggagtgcacggtggggcatgctgaatgtgttattaactctctgcatcacctgggtatgcgtttctttatactgatatgtgtatgtgtatatatatatatacgtatgtatgtatatatatacacacatgtatgtatgtatatatatacatgtatgtatgtgtatatatatatatacatgcatgtatgtgtgtgtatatatatacacatgtatgtatgtatatatatgttcctgtaaagtgaagaaaagctgtcgccagaaaaagggacattcatgttttatgtgtattatgtgtgtatatacacaaacatttgtatctatgcatacatgtatatacacacagacacagatacacacatttcaaaaatgaatgtacctctctctggtgacagcttcccttcacttttttttttaacattacatacatattttgaagaaaaaagactgataggatcaaaatggctgcaggcattttatgggcttggggattgtctcctcttccataaagaaatagtaaaacaagaggaatgaaggaagaaacacaagagaggttaacaaatagaaatggaatgattcaccccctttttctttctttcaaggcctgtgtctttacccacagataaataaattcctaacacagtcatgcagattcacacatgaacagcggggctctgcaccgtcttggggtgcacctgcagtgcgaggtgctcgatggtgtgtaacacagcaacatgtattgctccatgaatatccctgtgctatcgaaacctcctattggagaagatatgttaaaagactaccatctttccagtcccaaatcacttgcatcttggaattactgagttgttggccattactttcctatccttttttattttaaggactcattgttgtgataaggttggacacagttatttttccttcgagaaactttgcatatttttatcttgtattgtcacaaaataattaggaaagtctcctaatttctgtatacctttctccaacacctatctttctagcttgggtctgtaaatgttccaggacttggattatccctttgctggttgagtacctggcatctagcatattgcagcccagaatacgtggcaggctctggggatgccaactcattttaaggagaaaacactcatttttcctgtgacaatgagcatgacattcgcatgcttgcatccagtaccgacttgctacttttataccaaatggagagacgttactaaatgaacatttcttgctcttgtgtaaatagatagattaatggtgttaagtgaaagccaagcctgcttgaaatgttaacttccttatggggttttgagtttctcttatttttgataaatggaccaatctggcaataaaatccttgcacagtaggttaataatgtcatagctgaactgtgaaatagtaatgtgtgtaccatctctcagcaaacaataatccttgaagcctgataaatctatttccagcccaattgcatgttcattgttacccacaactccttctttgcaaatacaaagcagtttcgtcacatgtatttttaagcagaagcaactagggaagtcaaagacacatagccctgtgaagggaggtgggggacagattcatttttagctcttctgagcccctcctgcccccagggcctgaagtcactcctgagaatccctgcattgctggttggggtgcagtgtaaccttccagtcctccctgagcccaaatcactgatttgctgctggaagcagacaaggattgggaccaaggaagcaaacatcccccaggctcttcagttttcattgatcacttggttgcaagcaaggtttggtgctatttagcccatatccctgatgacaagagaggtgatgtggagacttctctatgctgacttcccatagagctgggaatatagaatctggtgaatgtctgcaggcttcagacagcccgcagcacatacagacctgtgtgcagagcacttcagcaccgcagcagatcgtaaacaaaagacagccaaatgccctccttgtactaacacagaggaggaggtatggccccctcttgcccatctgtagccaggggcaggcaagtccagggtaaaatttacactgcgttgctaaaaaagagaactgtatccagaatcacgggtgattttgaggggattatttaagcgtcagaatctaagtagcttggggcagttcacataaacttgacaaacaggctactttagtcctgtctgactgtatcagcataatagggcaatgaagcttttattcattcaaagaaaggttgagtttgattggcagggcagcctgcctgaacgcgagtggctctttcccccaacacttctctgctatcaattaccgttttgaatacgaagtgtttctaatgtaaaataatgccaacctctgcttctgtcctcaggccccagagtttctttgtgttatttattcccagtctgtgactgttctgaaccttcctctctttactgtgtttttttttcccctcttcttcttctttgcagtctgtaagtgatgtaacattgccagcagaagtgaggttcatgcagaaaacattcctgctctttattttaatcaataacctcctgggtgaatgacatttccaccttagtgatttaaaatcagaagaccaggggatgtccgtgcttgtgaatcacccggggttccaggaacaaagaaggcatttttgttttttgtaatttccccttcacactacaaacaactgggctctgaagttgatttcatttagcagtcaacttctgtctagaaaaatgtgcacaactgaaccgaacaccgttcttatttaaatcggcaagcgatttgcttcagctgccatctgttggccggttagctattttaatttgatgctggggacattacctgactttgtatattgcattttgatctgcatcatgtttgagaaatatctgcaaatgactctaagggagaggactttgaaggattctatcgaacaaatatgtacatatgtttagtgccgtgctgggcagaggagtgtgggaatgtaccagcgtgtatataagacagtgtgcatcttacctaataatctttatggccagattgagaataaatttttcgaaattttctttcttccgcatttccaactgacccttatttaaaagtcattaatgttgagctctctcatggtatctttatccatttttctaaagctgcggtttctcaggttatcaagtttataacccttgtgagcaagtcacggatggtggaggaagcatgatggagtatctgcatgagacggggggctgagtgtgggaaacttgtgggatcttctcatcctccctttctcagagcacccagagtttgacagcgctttgtgagtgtttatcaagagcctcccaaaagaggccgtggggcgatttgcgaagtgcacaaggcaaaaagtcaatagcctgttttcttgtgctggctgggcttcttgccattaattagttgtgtgatttggggctagtcctttaacccatctgcacttccatctctgtgtgtgtaaaatgaggtgattgtaccaggcgatctctaaacacccttcctgccctgatgttccagaaagcctggttcgggagagagagagacagacacagaaaggcgtgtggcccagtctctgctctcaagtatttcaaccataggagcgattaatattcactacacagattcaaaatcggggctactccagggctggggtgccctcctgtccgtttcttttctcctctaataaactcaaattgcctacaacttttctttttattattattattatactttaagttctagggtacatgtgcacaatgtgcagatttcttacatatgtatacatgtgccatgttggtgtgctgacatgcacacatatgtttattgcggcactattcacaatagcaaagacttggaaccatcccaaatgtctatcaatgcctacaacttttcaacatgattttattcttctcagcattgccttccacacaatgctcttttctatataacttcttcctgtgaggttctgtaatatttgctctgtgcctttcttttctcacattcattatctttcaggtagaaacacccaagagtgtttccacttgaactttcctttttctcaggacagcctctttgccaaacccatcttgacgcatgtactctcttccttgagcgtatgtgcttgcaaacactgtgtatggtagaatcatatgttgccacattgaagacatataagatgcctccagtttctatgttcaccattgtgatcattgatcacatatatgtgcccagttacatactgtactgaaccaaccatcctatgccagacgtttacaaacaaaacattcagaaaacagatggggcatagaggatgataataaggcagagtggatggcaggaatcagcagagtgaataatagggatgtagactagaccaaaggagaaaaaaaatcctgggagttttggttgcaaatttggaatgaagagaatctattctttttttctgtttattgggctttaggactgtgtaaacaaatttaggctggctaggccaggcatagtggctcacagctgtactcccagcaagcactttgggaggctaaggcaggcggaacacttgaggtcgggagtttgaaaccaccctggccaacatggtgaaactccatctctactaaaaataaaaaaattagctgagcaccgtggcacatccctgtaatcccagctactcaggaggctgaggaaagagactcacttgaacccgggaggcggaggttgcagtgagctgagatcattccactgcactccagcctgggtgacagagcaagactctgtctcaggaaaaaaaaaaaaaaaggctggctagaagtagaaatgtgtgatcttggggaaattgctcaaattactcgtctgagtgtcagtttccttgttgaaaaatgaaggcagtactagtatatacccacatcatagtgttgttgtgggggttaaatgagataatgagattaaatgagacatagcatttagcagggcacctggcccacaataaggattcagtaaatatttcctcttgttactgttatgtggaagtcataacaccagaaaccagtgccttaattgaagagatacttttagagaaatgggcactagctttgatttgggaggctctgtggtcacaagtccctccaatctaaccagtaaagctttctctttcctctctctcttcccatgccactttctcatgctcatatacatttttttcctgctgatagttatatatacagatctgtcctcactccaaagcaggtcaatattctcattgctgttcgttgcaaagtcataggtgatttattactagggaaaatactttttggactctgcatttgcataatcaattagttagtgttttctgggttgtcttctgcttgcaaattgatttaaacttctcccgtgagcagtgacaagttttctttggacgtgagcacctgacagagttgcagttggtttaggttccatacagcaacatggagttatgttattttccattgtgactcaggagttggcatatgcattctattccttgctggttttgcaggcactggaagctattatttccagagcaatatatggcgaccggaaatgacttcgttcctaattattctaatgaggcttcccaaccattattggaaaaggaagccatggaaattgtgcatcctcacaaaacttagtactgtcagcataacattaggtctaaaaaggttttcaaaatataataccaattggaaagtgtgtgtgtgtgtgtgtgcgtttgtagtatttggttataaactattatcataactcagggtcactaaaatgtctctctagaaagagaacagcctaacaggaatgaaataatttagtctctatttttgatgaagcaataatatttttgaacagtcagctgaatgccttctaagttgcctgggtgcctaaagggcttagaaagttcttccatggagataaataagctgtcaattcatgatgaagaaaatcaaactcatggtgttgatcttggctgggacgctggtacaagtatgagagaaatttttgccgagatgtagcatagcccatgtgttagcagttagcactccagtgccatactgtgcctctgctcgccttttcaaaaggtaaacatggctgtcgaaataaggaaaagaaaagattaacccattcaggggcatgcacctagtaagtgacactgtagctccctagaggatacaaaaagaataggggcaagagtccagagagtggctgttattcagttactggatttcctcttctcagcaccttctcagagttgggcttggaactgtgggcttggaactgtgggaaaactgaagtgaatctgggtgcagtaggaaaaggagttggtggagatagaggcttcaagaaaatacatgccaaaagccagttcacttgctcagttctttacacttttacaataaaacagggtatttctctgactttgtggtctaaagtcatgcatattttggagcacctaaaagaaaacagcaaacagcttacttctatttgtaccaggttagtgcacgaatgtaaaaaagacctctaaatgttaccctcctattatgaaaatccaaagctgggcatgagcagaagaaagggagagaatcatgctattttttaatttcctttgtattaatacaatcgaaagggggctatcaaagcataacactggcctgccctccagctgctgcggtaggtggcgtttcactcggttgccttgagatttacaaattctaaaggtattttcatgcctccaaattgaacacaaaaggcaggcccatggaacagtggctctgaacttcttaaactgaataatagggcaacgtgaaactttttatggaaagatgttgtttttcctgaagttcttgcagtacaggttgtaggagcttccttttctctctatgccctcggaggtctcacaaagcagcaggctcagtgagaccgaaaacatcagtgtgtctcccatctaggaagtctccagtaataactggtccatgtaatgaaagtttcttctagccaagactcaaatagagaattctgatgtaacttcctgaagagtacactagagggaaaaggggtcgtgggattgagggtagagatacatgaatctctctaagcctcagttttcgtatccttaaatggagacaataataatactacctattagaggtattgggaggctaaaggagacagtgcctgcaaagtacagtgcctgctttattgcaagctcactgtaaatacttgaggttgttactgatttttgttcctgctaatattattatattttatattattggccgtagtgtttcaactagtcatgtgataccgaatatgccatggaacagttttttggcctctaaacttttcgcatccacaaaatgaagcagttggatcagaagatatctaaggttccttcctgtgctaagatcctagagtcctaaagttccattcttgttgttgtaatgaagtgaaaagcacacatattcataccaaaagggtcataaatttaagattcttctgtggagggactgggaaaagtctttacagttttaggttgtaattaagaaagtgaattatgctaaaattgactttaggaaaacaatggtgttttgtgtaaccacatggatatcatctgggtatatgtaaataggaggcaggtaaaaatgatgaatgctaatctctgtaaaattcaaatgaatattaactcttattcaaatagcacaagtacattgcacagggaaatcaagacgtgaattcatataatttcatttttttcagctgtgcacatcctttggttacagaaacagctcagaacttaggcattgctcatttcctaatagagtatgacatctgggctgctacttttaaatatagtagcttgtttgctcaggcttatggctcagtaatatttgttttgtcttatgaatgtagtgaaagcagggattacaggtattcctcaaggactaattagaaataaaagcttatgtatatgagggaagttttcggataggaagtgctcttgcttgagtcatgaagtgacactggtttcagtttcaattttgatacattggaacttggtactttttgtagagtccatttggaaaggttaaaaaaatcacttggaattatctgcagaagttcaggttaaaaattgtttgtccttcttcctcggtttcaagctcctctaccctattgacaaattcataccttcattcctctgtttggattttaggaaataaattcaagaaaagaaaaatatgtaactatcatcactgtttccataaaataaaggtgttctagagatcaaagagaggccttgtcttggaaatacaatttggccaaaactgcctggtgtgtgtgtgtgtgtgtgtgtgtgtgtgtatgtgtgtgtgtgtgcttgtgtgtgttcatctctccatgattcattctgagagctgttttagccttcataaaatattcatgctagttgtgcatggttctataattgccatctcaggccttgaattatttataggttgtactgttcacatagtctcatttactgatagagaagataacaccatacaagaggatcccaaacactctgaggcctgttactttgcattaagtagtggaattatattactgtaggtgtaaaacactggccttttttttcctcctctccctttaatatatcatttttgtatttataatatgctaattgtcagaatgctgttaagcctcataattcctgccgagtcttgcagaaatcaagatgtggctgagatgatttagctcttgatctcagaatgatcgttctaaaaaaaacctgtctacacacagcgtaatttattgaaatgatgtatgactttacatgcatacctgagcccttttgttttgtactattgatcagtttgtatgtctcagtgttaaccaacacgtggttggtttcggtagacatttaccaagagccttgcaagcttgctgtccctaattaaatactgagtctcaattcacttgtgtgacagtttctctgcacctatttattttgctttcctaattctcctttcccttttctgccaacttgatctttcttccacatagattatattcttgatatttatttgagggtaggaacatgctataggaacatactatagttgtatctcctctctctttttttggtgttatttagttgcaaaagtccatttaatgttaataaatatcaaaagccagattcaccacagagtgtacttttctggtatttcattatcagtatccatgtttaaagaggaaaaacagaaaaattcatggcagctcataatctgctgatatattctagttttctcctctaccagtggaaactcatgaattttcctctggcctaggaacttccaactctatacaaatcactaacaaacaatcctccatctcctctctttaggctgatcaatattttctctctagccttctttccatcatacaggttgtgttcccttatgtgtgtgatgtgagctttcccatacctatattagccaactcgcagcttctcactgttgatctgcatactgctggtggtggtacttctcactgtatacctacatactgctggatgcttttaagtggtacctgtaggtgtctttaaatagcactgaattaggtgataagtaaatcatcttatttaaaatttcttttagttttcctgatgaggccaaagtccttgtttggtgggaatctgtctttaacacctccctcacatttgcttcatcttggttttcaatgagtaccctgtggtaggcaacagtatctagccaaaatttagtaaatttttaaaattttgtttacattcacttttaattatgttgctttcttttatctcagataagtagtatgggttttcattcatagtaggaatggaaagtgtcattcaaaaataagtttattagggataaaaggaaatgagtcagtatacataaaatattaagtgaatattattataggtaaaaatggcaaaaactctgaaggtgctgttatgagtgattgaagttcagggaacactgtggcaatgccaaaatgtggcgaatcactctagagagctgtgtattctatagagtcaaagggaatggaagggttgagtgatgcataaaaagaggatgtagaatctaagatgctagtgggggtaaagacgtgcacttttgggcaattcacttatctttgtctttagacagtaaaatccccactaactagggttctggtcagtcggcttttctaattgaaggttcacttgtattgatgaaaatcatttctaatggcacaggagtcccatttccactatagtaagtcagagttgagggagaaattgactatcattaatgaatgaaggttttcaggttgttttaagccattgtggatcttgtaatgttgattagcagtaaaaaaaaaaaaaaaaaaaaaaaaaattagtgtcattcttgactgaagagccctggacaaaggtatggcttttgataaagccaaaatattagcttgttttgttattcaaagggaatgtgctctgggagatttctggtctacacccagggacagtgcctggcatattgtaacagcttagcacatacccattgtattgaactgaattaatggtatgtagcagggctctgattaactaatagttcctccaaaaatgtacacacagaaaagaaaagtgaagcatgattgaagatgaaataagatcattgtttcatctaccagtgtatcccacagagtaaatgcctatgtttgtacactgggtggtggcccaggaataaattatgtagttcttaggagctttcgacagttcacttgacaagagtgaattgtgtgctaagcaggttttaaaattaaaattcagatatgaatgtcttgcattctcatttccttccattctatcaccaaaatcagaaaagaccaaaaacagggccgggtgcagtggctcacgcctgtaatcccagcccttcaggatgccaaggctggtggatcagttcgcggggtcaggagttcgagaccagcctggacaacatgataaaaccctgtctctactaaaaatacacaaattagctgggcatagtggtgcatacctgtagttccagctacttgggagtctgagacaagagaatcgatggaacccaggaggcagaggttgcagtgagctgagatcatgccgctgggctccagcctgggtgacacaatgaggctccatctcaaaaaaaaaaaagaaaagaaaagaccaaaagttttctacttgggtagataggaaagtccagtctaaaggcagagggaagcttaagaccatcatggggttgggatgactgcatctctcctgactacttattagtgtctgttttagcaacagaattaggttgtgaagtatgttttgtaaaattctttccactgactttccatattcttagaaaagccatggctgcaattccaccaagtgctctgcacctgctgtggtaactacctgccttcttttaggctttgatcccattggacctgactgttccaagctggtgctgtctgggtttttgttttgttttgtttttagttcaattctagaaaaatgaatttggtgcattgctgtaggaagagatcctggatcgtaaggctaggtctgaggaaggttgtggccccaactctgcaatgaatgaactgtgcgtcattgagcaaatccactaagctatctgagcttctatctccccatctgtggaaagacatgactgaattagaggttctccattgtaacattttatgattctatcattcctgtttccacctatggggatggacttcagatccttggccagggggttttataaagtcagagcatcatttgtcataacttaaagaagactgcttgttaaacatttcttatttctgcctccctagacatgtgaccatctgcaagaatgactttctggctatttcctccctattttgattgttctacatattattattattaggtaaatattcctaatagcaacagttgtgttaatgcaattgtatggcatttttttccaagggagcccaaatgtgtctagaactttatttaattattattttttaagtcaggaggggatggtcatgcagatttgttctcatgcagaactttgttttttctaactacctggcatttggttttaatgtcttaatttgtcttctgcagcaatctgcatgtcagaagttgaacctctccaagcttatgctggtcttagaccctaaggcttgaagggaaagtagtagcagctagatgagcacctcacttatctgatatttcttccaagtagtgcctggtcttttctagaatgtgtgctgtgatagggaattcatcttgtaaggcagccccttcactattagagagtatttttttccttctgtcgtattagagtgttccttcttgactgaattttcaggctttggtcccagtctgtcctatagactttttaattgtaagtttgctgcttcgtacaaagagtaaatagttcaaatatttggaaacagctatcttgtttcatcaagacttctctctatcagactaaatattccttcaaatattctcctcatgatcttgcagagtcctctgatgccctgtccactctatgttaaatataaacaagtacaaagagccagggcattaggtgaaccagatgttggttcaggtttcagaccttgctatgtggttgtgggctagtgggcaagcctcagatttctcattcttttttctttctttttctttttgagacagggtctcactctgttgcccaggctggagtacagtggtgcaatcatggctcactgaagccttgacctcttgggctcaggtgattttcttaccttagcctcctgaatagctgggactatgggtgagtaccacagtgcccagctaattttttgtagagatggggttttgccatgttgcccaggctgctcttgaactcctgagctccagggatcttcctgccttgacctcctaaagtgctggtaatacaagcttgagccactgcacctggccagatttcttaatcttcagatggtgatgatatttgaaaatgcctaatgtcatccacagtctatagcagatgctaaatgaaattttattgcttcctattactaactttattttcttgtcctaaattatgacatctagtaatggtggaactccagaaatgcccagtcctttctggaggaggggagcagaatgttcacatcacctcaattatgaacagtgtatttttaataacatggccaaatgctattttgcctttggttgaagtggagggcatgcacacttctgttgtgggctctctaaatctagtccttgccaatgtgctttggaaaaaaaactttgttttggcatgaagtgcactgcttgttgatacacagtggcagctttggagcatgaaatcttgctctttatgagtatttggcatattgtggaattagagttttgccttctctgggttttcttggctttcttcaacagcctccctacctggtccccaaaacaaaacagcaggaataaatatcaccctcagacatgcctctttctcattcaaaagaaaggcaaacaaaataggtatcccctagagcacagagaatagactctccaattatcttcatgaaagaataaagacagtctttccagtgttcacaagatcaagtagtgaatatgtcatgcatgattccaagtcactggcctggatgaaaaggcagagtgaagtgaaaaggggatggggagaccttggatttgggtaggtcccaaaagatcaaaacaaaacaaaacaaacaacaaaacgtgtgtgtgtgtgtgtgtgtgtgtgtgtgtgtgtgtttattaggatctgggccaattagggaaaaaaaagagaacactactaatataggaaaacagaatgtttggagaagaggaaataggagggtctcaaggatttcatgcaatgaaatgatgttaaaaggtcgggggcgggtattccctcctgtgaccccacagactgaatggcaatgcctttctctctagtgggctggactgaaaagtgtggtgtattctctcagggtatccagatcctttgggtcctcccggataagcaacagcacattgttatgcaaattgttctattcccagggggatctcactgcgccttgtgaagccctctctgctgggaaaagcacttttcagctgtctcctcctgggttgatatctttatagagcaaccagagcagacagcattctgcattttcttccatacggcggccagagttctggtgtcttccatttttgccttacttttacacacatacacacacgtacacaccctaaaccaagtgcctttttcctgtgacacactgcagaaaacaccagtcctggacggagaaaaagttgaatgccacatttcatgattccaaaggaaaagtacatatcatctttcttttctttcttggtccggctttgtcaagagaacatgaaacctccttcgattgctgttagttgattctatgaagtcattttgaatcttttcaagagtaggttaaaagttaatgctttcaacatcaaccatgttgaaatcatttcaagttttgcttatgacattcccacccttttgtccccagcaaagcattgccatggcccttgaccactgtgcagcattttcagcatcttcactgcatgaaaattgtgcaaacacccagagacaggggcaccatgtaatcacttgacttattggtctgctagtctgtactgttgcacaccatgtgtggctgtgtgacgtgtgactccagaccgtactttgaagccattttcttgagcatcagacgttgctcagttttcacataacacaaaagcactgccctttcttcactgtgaacttctctctaatgtattaggggacgtgaagggtgttagtccttgaactagacattcacagatcccagaaaaaaacaaacaaacccaaaagactgaactgggcagtatgttccctgccagatgaagtgcaatgcaagtactttcctaatagacatgtaataaaaacatgtttggagctctcttcttaatttcctttaaatttttgagtgatttttttttaggcagcatgtttagctctctaacatctctaacacataagttgaaagaattaaactctcagccatatacacacaaaattaaactctataaactctgggtttataaaacaggaatctttgtctagacatttaaatcctaaggctattatttcttaatgataattcaatgacagaatgaagaatatggcaaaaaaaaaatgaataggagccatcttttatgttgtttgtttcttggggaactctgatttgaatcccgtccctgatatttgagcgaaatccttgtgtcagaactacataaagaatttccagatgtagatatacagtctttagagaaaaaaaaaattaagcttttgtaggatttgtatagtcacatggtaatgctatcttctgagttttgtaggcaagtagaaaaaacaaatgaaggcagagtctgaaatggtcgaatgctcatcaaagaggagccataatagcaaccctggaaaatccacttcaaacttttcaagtatctagtttttcaaatgttgttcctttttatgtccattgtaataattagctctgaagctaagataggattacagggagaaagaaaatattaacaataaaatatctaaccatatggaagtcttggtacactccaataaatggagaggtgttttcttcccgcaaactaaggcaggtgaggagaattgtctgccctaagaactcagcccacagagctgtgaccttgtatgcagattgattcccaaggaaatctcaggccttctttgcccctagagttttgtcgctgtgtatggtgttcaatccaggtgtgcaaagacccaaagtgtctctgtagttccagagctgcctctgacaggggcaaagaaacaaaaaaagggtcgccagttaaagaaacactgtatcccatcttgaaccttgagttagatgaaaatacggaggtaaagttacacccaaattacatactaatgattttttcacatatgaaatcatggcttagaagaagatatagattattcaggtctgtttagaagcaaataagtaacctcttccaacccaacacccaacaaccaccaattttgtcataaaaactcaggcccttcctctaattactggtattctaggcgtaatgtgaaccctctcctttcattgacaccattattagctgggatgtcaggctatcctgaaacctggccaggcacaatagagcagaacttacaacaaatttgaaattaacattgaccacttttatgggactgtcatggttcctagtgctgcatgtttaaccttttagagaagaaagtacaggggatattgcacagctctttgtgaaaaattatgcatcatatttattccatgtttgtgcctctgtgtatgttggcatgctttgttagtttgtgtggtatgtctgtatgtgcttagacatatgcactatgtggctttatatatatatatatatatatatatatatatatacatatacatatatatacatatattactggagtccccagtgtatagtttatagtttggaaagaaatcatcttccatcattcgtcactgcctagctgttgtagagtgggccagaacatcatttgttaacggcgacaaagctgcactcataaacgccgacatgttacattaatttataggcactgagtgacttattaaaagtgacgtgtgaaatataacagggcccggtatggatgattaggtttcgggctttgaattgttgacaaggcaggggtaatgaattgcgggacactggctcctgcatttccccctcattagtcagtattagctacattaatagtaataattggatatattcatcatttaaaatgttttaataaatgtttggacagtacccgatcagagctgtcaaatattaggctggaagggttgtgacaagagaaaaatgatgatgttccttaggtgagagatttatgcagctttggagatgccagccttgactttctactccctaaggatctctcagttcagatgagttagggttacaaaccatggaaatggggaaacctgactttctcctgtctcagaggacatttctgcaagaaggctttgaaggagatcaagaggccctgtccagagggactcaggtctgcaactggtttgcctaggatggcctctgggaagagattaagagacccagctctgacccaagttagctttgtggccttgggcaagtgccttcacctttctgagcttccatttccatgcctataatatgtttcatttgggtccccttgagatctaacattgtgtgagtttgatcatcaaatgtgataccattagcctagagcaacctctaactcacttcctcctttctccactcttactagtatttattgaggactaacgtatttgctccaacgatggtgaataagacctttcttttgcctccaggaaggtgatctgcagacattctttaagtatttgcagcattatctctgtgatacggacatggttatattcctgcagtaattggagcctagatgtacccaattttatggtttagttctttattgatctttctctgttactgtgatcagattagagtgattgtattatatgcaaaagatctgggggaaaagttttagtagaactgtaaatggctgctattcccctactctactacagcaaacacaacacaacacggcacaacaaatatatcttaaacttgaatttgaacaaatgcagattttagatcaagatggaaatgattgtgatcccattatcaccattatcatcatcatcaaatttgtactagcttaaccttactgagcatttactatatgccatccacagcccttggaacttcatatatattcttacttatttctcacaataatccttcaaggtagatactatagttctcattttacagataaggaggcagaggcttagaaaggttaagtgacttggttatgatcacacaactgataagtggtagggcccagactggaacctttttaaaccaagttcatgtcataaccaacctgctgtgctgcctctaacattttggaggcttgctcagttctggcataattgaggaggggtgttggctaatcagagagtatttggaaaagggtgaacaggatgggaagggtttgtgaatcctatcttgaaggggtggataactaaaataggtttatcctggaaaagagtcctgggaagagaaggtgggccggtttctctgatttaaattatttttgggttgtctcagggaaggaggagatgtaatgctgctatctgaacccgagctcaaaactgaagtttctgaaggtaaatgataggagggaagaattcagttctcaggaagagggcacctcctggcagagctgtccagctcatatgggaaggaccatctcccagtgacgggctgctctctgttagagatagaatgatcctgcctctcctggaactgccgtcgcatcacctccctcctcgctcactgtgctgcagccacactggcctttgcactaactggaatgcttttctgggttttggcatggctgggctccttcttgcccttcaagtcccagccaatatatcataatttccaagatcttctcttctcccctttctaggaaccatcactttccatctgccatccattcttttctaatagctggagtcggtaactgacattatctttttttaacttgtgagtctttcacttgttttttgtcttttttccccactagaaagtcagtcgttggagggagagtgctctcctatcttctccactccagcaaccagaacaggcatagaactactggggcaaccatttgtcagggacactgcggaatggatcccttctttgggtgaaaagctactctagacaactccaatatttattcctcattctcgtagtctgtgagcacctcatttttacagcagtttcccttgcccctttggcttggcagaaaggtaagaaagacaagactatttgagattttaagtaaatccagtgtcagatctcggttagtttaaaagccagtactctcttcatatctaaggtggcccctgagttagattttttttttttttttttttttttttgagacagagtcttgctctgtcacccaggctggagtgcagtggcatgatcttggctcactgcaacctccacctcccgggttcaagtgattctcctgcttcagcctccctagtagctggtgtgtaccaccacaaccagctaattttttgtatttttagtagagatgggcttccgccatgttggccaggctggtctcaaactcctgacctcaggtaatccacctgcctcagtctcccaaaatgctggaattataggcatgagccaccacacctggcccctgagttagattctatttaccccctcagtaactctgtgaggagtctctgcatctgctgccattgagcttccggtttctgtatattttcatgagactttggcatcatttacgtaaaatatgtttagagcacaccaaagaaaaaggtttgagttatattgaagagactttatagagtttttatttattgttataaatgatattctgcattttatgaaaaaaatcaagattatggtcacacagtataaagctgcagatgttttttgttaatacaatttggttttgcaaacattccagcatatttttttttataataagccatgatactctgcacacacacacgtggtttacagctagagtgtcttcaggctcttggtctttgttactttattttggattctcaattatttcttaatcgtaggtagcattttatcatttgttgttccggaatcaagcagatatttataagctctatctcaggttctgaggatacagagatgaacatacatggttgttatcttcgaggatcttactctctcattccggggagattggtaagtggcagtcatagagcaatgtgacagatgtggttctggaggagtgtgccgttggaaaactgaggtgggatgttctattcctgtcgggaggaacttgggaaggcttcctagagggagaggtaggagttgtgatcattcttgaaatataggagattttttagaccaggaatgggcaggggtgaggacttacatggggggaggcttaagagagctcagagagtttaggaaacatcaaatgagttagagttccaaaccataagcatgaaggttacaaacctttagcataaaggaacataaaggatagggggcaagagatttagctgactgggtttttggtgccaaattgtaaatggtggactttatgccatgtgacagtgagaagagatcacatataatttgagtcactagcagttgtatttgaggctgacctctcaggaaaacaaaaagtcttcaaaatcaaagtcagggtctgtagaattcaatcgttcaagaatgtgagtctaatgaaggactgctgttcctgagcagatgttcttgttgaacaatttccaggtataattttaagaaaatgataatcatattgtaggtcacttgttttgaattttccttaaagcctaagttcacaatatggtgtccactttgcaaaggatgcagtttctcagggaggatataacttcattcagactttaagcagagatcgcttaaaaaatgagctttctctcaccctactcttggacatggtatcttggtggtagcatgggccaagtagaaaacctgactgtatccaatattgacttgctttgctgtagttgagtccttttctcagccctgtagcaggcacagtgggacaagcatagtggcacgtagggggcttctctgagatagccttcatttgtagttacttctagtccaagatggtgactacactgtcatgggtttcaatgcattgtagaatggcaggtgaagacaggttggatcatggatatgcaatatgtgctgcttgcttcactggagtttttgtttgtttgtgtgttcttgttttttttaataaacattggatgtccctggaacccaacttatcaaaaccatttacaccattgggccactttttgaagttttcccagcctactttggctgaatctgaagttaccttgacctttgccaacatttttttttcagatgaaactattttaccctccatctccagcaatctgccacctttgactcagaaattcttgttaattattttaaggcaatccttggttattcagataaaattttacatacaagaatgttcaccaagggattatttatcatagcaaaaaaatttgaaagtaatcaaacattaggagatcatttgaatgtctactgtatatgatgaaatgttatggagtaaaacaatattttgaagatatgaaataacataaaaaaggatatagtgtctgtatatggttattaaatttgtatgtacttgaagagattgagacaaaatgggatacaggtggcttttatttatctatgaattttggattttaaacatttttttttttttttacaataaatcaacctttataagaaaaaaatctagacactatttcaaaatatgccacttggaattttaaagaggtgtctctatgtaagatgccacataaccaaagaaaaggcaaggtgatgcatcatggccaaaacaagtgggaactgctaaagtcaaactaaactgctttggccctgggatctcattaagcagcagaggagcattaattgaaggcagcatttgactaagctaattccggacatttctctcaactcctgtgccattggtttcaagttgcagggaacatttctggctcaggccaatggagggagcatacataaacatggggtttattttgtcagggatgttcttgagagactcaattctctactgatctttttttgttctttgtggacatttatttacttttgaaaatgcccctgcagatcctcgcttgagtgaaaaggagatgtgttctcatggcagggctccattgctgatcagcaagtctctaaaaattgagtgtacattcggttactgctgtttttaacattctactaggttggcttcatttttataaatgaatgatattttcacaaatccgcatttgatagacgccattaataatgtttctcttcaccttccagttcctttatttttttttagcctgcctttgagtaagattcttgataatgcgggttcttagctatcaccttgaatcctccaggggacacaggggacaagtgaccagaaaaggtcccagttgattttactcatcacccctttagtgagtgcatgagaagagaggagatttacagttaaggtcctaaatcagttctggctgttaaagcttttgttgaggatttagggaggctaaagctaaaactgagtgtcgtcttggaggttaatctacccagctctggaatgtgtgtcctgctccctgtgatactgacatggtgaaacagctgatggttagaggcccacgctcacccttgtgcagggtgctggaggtggatgtcatgatggcgatatcagagttctgaggcaaaagggatttatgcgccgagacacacatgcaacagagacgcaagatgcgccatgggcttggactgaaggggagaaggagcaaaagagtctgagccatcagaaaatgtcacttgtttgtcttaccaaaccttaagcaacaattcttaaaattcaagctgaccacgttggctcagaaaagcaggcagtgagggttttcttgtccttctaaaagtgaaaagggctcagtggcactgaagagaaccatgccaagatggcagccaagtcctatctcagtggaaattgtgagaggtggctcctgtccacatggtggtggcttgtctctacactctgagtggggtcacttataccccagatctgcattcttatgtcagaagccagggtgagtaggcgttcttcacacatatgtgaataccttccaaagcatgatcaggtggctacaaatagtgtcgtgaacaagaacacagatattggccttagtcatacctggatttgaatccagggtcttgcaagtactagatttgtgatctcaggcagatggactattgatagtgtctaccttagtagttactatcttagggttgttgtgagcattcaataagatgatgttagtaaagtgcttagcaaatgaccttgcacatagtaagcactcaaataatggtaactttaaaaataagaataattgtaatcatgttgatagcatcattagtaggtgcggaactagaagtttattggcagtactgtggaagtgtatccatcaatacttgtcttatttttatggagatcccaaagtgaaatattagactaatgttcatttattcaccaaacggtgatgtataaacaagattctactaaacattgtggaggaaacaggattgtataaaatacgttcccttcacatagacggttaaaatctggttggccagatatgaaatgtaaatgcagataggcaaagtacaaggtaataagtgaccgatgagatatcaacaaaagccttgggaatttagataatgctgttctggccaatgtgatcaaggtggatttggagttggcttgaggagtgggctcgattaccttgcaatagacagctttccagacagagggaacagtatgcacagaggcttgaaggtgggaagtggccaacttccggggccaaaatgatgaagtgtttgaccacaggttaagtgaggggcagctttggaggtacaagtgaattagtttcagccagaaatagtcccaagtgtagtcagtgaggttcagcaaagcctcaaccctcttgaccccttctaggtgttcacagccaaatgaagccatcagattcatgcacagatacccaaagtgtaaaatgacctcagaattgtaagaaagacactcacagactttggacacctcagttgtatggagaagtgatatcaactccgaatgggaaaatctgggaagtcttatggggagagggagaatcttaaccagacctggaaggatagggggtctttagaagggagagaaaggcattacaggcaaaaggaatggttgagctaaagcttggaggtcagagagagctctgattttccagtgaacatgggccatattatatatgaagtccacaaagtgattctaatttgagttaaagaccaatgtaaatgcatatcacttgactcaaagggagggcagataagaactcttactggcccttttttcacattaacattgagatgcgtctcttgtatggaaaatggagaggggctgatttttcttttggtagataaacatgttgttggctggcaatgattgcggtgaaagtcttttagaccacccatggatgtcgggcagaagcagactgcctgagtcctctactcctaaagctcactgtctaaggagccaagacagctgcccattttgttcactgtctccctgtcactcacccggccccacccctgacctcattaggagggctttaccttccctgaaaagtgaaccaactacttccacaccaaaagatctgttcaagccaagcccctcttcctttcctctgagcccccatcttctggagcaggctgccttgatgtgaaatatagaggcacgttttaaaaatgtatgtttcagaaaaaggggaccttgtttttaggggcaacagagatatgaaacttgatattttgcaacataataattgtagcagaagcacagaggagagaatttggggagattttgggggacagccagggaagtgtcccagtgcatgtgatatttgatggatgggattattcagcttctactaaatgtttgtcccttaagccttggtttctttactttatactttgctgcttcaaaggaggagaatgcagtcttcagagcaagccagtgccttccagatttgttatctaatgatgacattgttatccagaggtggctttattttgaagtgtgtctgtgcatgtgtgtgtgtgtttaccattcttttgagcaagcaggtatgaagaagcagtacctgagaaggcagcatgtgtcaggcgggtctgctgttctctttgaagaattgccatgtctcagcttctaaatttcttaggaacctgaactaatgcaagtttaccactagatgcagccggtgaaatgccagtgtcatattacaattaacagtaattctggtggctgtcatcacttactccgaacagaggatctccagcaaaagcatgacaccgtcacggctgctaattcaaaggcattgtgtgaactatgacagaccttatggtgcaccttttatgcttattcaaatgaataaagtctagccacttaaatggaggagagggagaaaaagttttaacacatttctgcagatgagcccacgaagggtcaacttggaaaaaaaagttgtgttaaggaaagtaattaaacagaggcagagagattgaatattagtgattttgcagagtaaatgaggataaattctgttaattatgtgactttttccagtactaatgtgataataaagtactctaattctagagaggcttgtcacaatcccagctaaggcagtgacccttctactaggtgagaccaagaagcaacttataaagctttccagcaaaaaagcaagaaatcaaagttaaatggattttttccccgtctccatttttagtatggaaaactgctacccaacaccatcatgaaactcttggtgaatggactgtcttacttgaggcacgaaagcacttacacttactttttttttgcttagttcttgagggaagaaatgtgagcaattcaaagagtataaatagcccagtgcaggattctagtccaatgattaacagcaccaaaaagattatacttggaatgtgagtgaaatttggtcttcgggacttcaatcttacaaacatttatgtcattgtgaatgggtaggaacttgtttttaggggcaacagagacatgaaacttgatattttgcaacataataattgtagcagaagcacagaggagagagtttggagagattttgggggacagccaggggagtgtcccagtgcatgtgatatttgatggatgggattatgtgttgttcaggtgagaagggatgggagaggtgaagagaaagtttgccaggagagagccatagcatttgcaaaactactgagttggccaagcagaaggggtgctgagggaatgcagaaggatctaacagggttagatctaaccaacacagttggtcttcacatcaacataatctctgtggcagagagtaggaggcggaagatggcaaagatagttttgttccagatcacaaaggaaggaagtgattgtttcaagggcagaagaaaggtttgttttgttttgttttttctcgcttttaaaaaatagataggcatgttgccagattttaccatgcagtatctaaggactgagggaaatatggtagctgccagtgcaggcatattgctgtaccctacagtggtaaagggaacccagattcttagcccagttgcagttcttatgagcacaagctgtctagtgagactttgcgttcaaatattgtctatatctgccatgagctatctgttggcaggcaagttactaaatctccctgtgattcagctggtttcttacctggtgccctgggacaggaatggaggcagggtgagtggatgggggagcgtagggttgctgtgaggactaaaaaaatgtactaaatgtagtataaacattagctatgcttaactcattattatttttctaaagcctagcacttggtaaagtattcagttaggctactttggagcaatctttccttctaaaagaatcaaccatcatcaaaggaaattggtattctgagtcatcttggctaagaatcaccacaccactagagtgtgcaggcaaacttgcttccataattcaaggaaacatacataaaatcccatattttcccaggctgttcactttgagaacaatttatcatcattatctttgtaagagaagagccttccatatcaaaaataacactcaaaacactctcagcgttcagggaatggttttggaagtagactcattgagagggaacacatactaggttcaagcagacccagtgctctctcacgacacctcttggcttaaattggggtgcgggattgtgtcaggtttctctcagaggcccctctctgacatctggtagccatcagcagaagaaccccagagacagggatgaaaactcagagaagaattaaggatctctgttgtagcctgctatacctgcctgtagcttcttcttttcttaaatttgaagactctctactttgttttaataaactattgttttatgacatttttatttatatcctccactttgtgtggctcttcctgccatgcttaagaatctagcctggagtcaactgagaaagacattgaagaacaagtgcgtgtgtttggagcagggcagggggtgtcccaccatggtctcgtttcagcaggtgggtccttaagtattgctggggcaggatttgttttcatgtgttatgctacagatgaccagaggtgctggggagaaagtcctgatgcatagtcactgttatgagttagaaaattcagaaagttgagaattcatcaggcgttcatttacttacttactcattcacttagcaaatatttgactgccagatgccaagcaccgtaataggatctgggtatgacgatgatggggaatgagagggggatcactgaggtaggatacaggaagacattcctggggagatgacatctcagagacctgaagggtgggagagaactagggccagatccctccaggacccagggtggggaagagcttggcattctgtggatgtgaaaagtagcccccatggctggggtgctcacgaatgggaactagaggctgccactaatcagctgggtgaccctgaccatgtcacctgatttcttggagcttcagtagactcatctgtcaaatggaagtgactttatccactccctgtcatatacttcaagacttttcgggaggatcagttaaagaaaagttagaaatgattttttaaagtgatgcacagtttaaaaggtatagcctgtttttaaaaaattgttattgatttagtggaaaattattgcctatagaatttagcataagtttgaatacctgtttttgatacaaggaagtttatcctcattaataccagaagctggctcttatcacgtggttttacttttaactcgctgcaggggaaatcagtgagttctatgctaagattttgctctctgttatgaacaatattttctgggcccagatcctggttctttcacttatatgtgacctggggttcttttactgattcccctcgcctcagtacattcatctgtagatgggaatatagtaggccctaacattaaggggtggtggtaagaattcattagaatgaatgtgtaaatgcccagtgcctggcatgtgctgaccaaaatgggagctctttatgtgaaaatgggagtgattcccatgccaacaaggcctggccagattcaagggtcctcccattaaatgtaggaagggaaaaaacttgtttgtgctgggtttgatggcgtcttctttcatacagagagttccaaattgctgacttttgaggccacagtctctttagaagcaaggaggaaggcaccgagtcagttgttttgtttcctgcatggttaattggttgtaaaatgctactaaaagttactgcttctgattaaattaagtgccctgggaaatccagctgtgaacaggtgggtattggaggttttccctgtgtctctattcactgtctgtggacagcctcatgctggtaaatatgcactgccttcacttttgcttctgggaccagatgcttttcccaacttctcccttcacccaacccgtcagctgccaaaggtctgggagaaaatcaagcttgactacatctgaatttcaagtgatgcgatccttaaaaataaccaaacaaaacatgccattgcttcaaaagcaagaactatgtttgttttttaatgagaggagtcccatttagtgtagccacaggggtccttgttttgttattgtttttattttaaaatgggcacaaagtgaccctgccctagtcttgcagacaaatgacttgctgccactttggttattacagtttagggccggagatgcaaactgcatccctctaccagatttgttttgtctggcccttctgtggtttggaagattggcaaatttcacacttaacaatatgcatttccagcttctcttcaaataggagggtctgacaacactgtacccatattgccctgtggagtcagtcggctggagaagagtcaagctgtccctgaagacaagacgttgactcttgagttctgataattcccagtactctctgtggttttacatgcagcctagttcactcattgattgaccttcctgggctctgtagggtctgcatttgagactctgaatttaaaagcttctatcattttgaaagttaatagcaattctgtatgtgaaataaaaaatatatacataaatgtatgtgtatgtgagtgtgtgtgcgcgtgtgcatgtgatagacttaagaatattgaagttgtggagcctaaaagttaccagcactctattgaatattctctctcttacatttttgagactgtctcgtctcctgccaccctctcagcacacctccttctccacttctccttatctttcttggagggcattgtatgatgtaagctcttcttaccttctctcctccccacctatgaaagctcacttttccagtgatctctacaaggtggaatatgaatggattatattctattatagattcatctcaaatgtattgaattttccagcaaccccagctgcacatctttttgggttcaactctcataaatggaaattccatctctttttttaaagccgcccaaacaaaaatcctgagactagctcagatagagcctgattggcttgacttgggtcacatgccagtctctaaagcagatatatagttgggggttatgatactctgactggccaggcctaaatcacaagtgcctctttggtccaagtgtggaatgagtttatgctgctgaaatgtaaagactcttgagtgagggcgaagttgttctctaaaaaagagaatagcagactgttatcaaaacagaataaaaaggattctggcagtcaattcagactcctgtcctctgaagcctctggacccattccacaggaaaacaagtatacaaaagtttgcatacaatgttggggtgatcacggatgccatgtagaccacccactgactgcaggttaagaatatctggattagatcatttcttatcccattccagcatttttttgtaaatgatcaaccaattttgtgataaaatgaaagcttttttcagaattatgttttcagtgtttcaggtttaaactgaagctgttcaaaagtgacatgcggggagggcaagcgagtgacctgtgagctacaaagcaccctcagaaagtctaaatgctgtcattgttcgtctctgatactgctttagtttcattttccatcagcatccttatgatatcatgagaaatagtgcttaataaagtgtcagactctattttgcattatgatttcaaaatgataaatttcttcttatatttttatggactagaacacacaggcttattggatcgtctataatatagactagaataatttggagcacaggagattattgtcagtgctctgtgggcatgatgctcgctggtcatttttatttgtagactggtcctgaggtttaaatccaaattaaggagtcacttgtttttatctgagctcagcttgtgtggcatgttgggatgcagagattttttttcaatgaaatccattgctcaaattaaattcattatccccaatgatgtgtgaggccgggggatgacaggcaacacatgaagatgctgagactgggacaagggagggtatgatgggaaaagtgaacagacagatgcggtgaatattaaaagggtaatgattatttaaaatagtttcaaaatacttttcatccttagcaagattctgtgtcccccaccccccacaccttggggaatagctttttcagctgatcccttttgtctatatgtacttttttttttggttgaaaagtgagtttatttattttccttgaagcataaagtttccaaatatcagctttctaacgcaaacaagaaccccttccctcccctccctccccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattgcaacttctacctcctaggttcaagtgattctcctgcctcagtctcctgagtagctgaaattacaggtgtgcaccaccacgcctggctaatttttgtatttttggtagagacgaggtttcaccatgttggccaggctggtctcaaactcttgacctcaggtgatccgcctgcctcccaaattgctgggattatgggcatgagccatcatgtctggctaggaacctttttctttccctgcagcttgtgctgggataagagaggatgggtggggaaattttatttttatttctactcagcagtgttttgacttgtttttttgagatggagtctcgctctgtcacccaggctggcaccatctcagctcactgcaacttctgcctcccaggttcaagtgattctcttgcctcagcctccagaatagctgggatttcaggtgcccgccaccatgcctggctaatttttaaatttttagtggagacagggtttcaccatgttggtcaggctggtctcaaactcttgacctcaagcaatccacacgcctcggcctcccaaagtgctgagattacaggcgtgagtcaccacacctggccctacttaagtttttatgctgaatttcaattgcacatgatgagatgcccaggcaattcacaatttctggtatatagctccatcatttcacttatcacatagtatggtattattaattttaagaatcaactagctatcaattctcaagctttagtgtgcatcaaaattcttcaaatgcccctctggtccaagtggactcatcccacaggaaagagtacgtacagaaattttcatacagttcctactttctctctgccaggacaagtttctgaggtaattctgatgaagacagcatgagaactgtacttcaatgaactttcacaagggaagggactgggttgtctgttgtatgccttctgtttggtgcaaagtaggtgcttagtaaatacttattgaataaggacagactgaatgaataaatagataacctaagaaaataggctgaatgaagaaatagtaaatcattaagagttttaactaagggtttcaacaaaagtcaacagaatggtctgtagaattttggagaagaaactaaacagactttagttatatggccttttattcctttgggttacacttgaatgatgggaaaacaatggcaggtttaacttggagataaaaatttctcaacatcaaagtttaaaatattaagtaggaagttaaggacaccaatggtgtggagccttcccagttgatactcatgtatgaattatgcaatatgaaactaataaatgatgtacattttacagagtgtgagatggatagctcttaactgttcacatttgagttaaatggtaaatcttagagcatagaaactttgagaaagccactcgtaatctttagttcctaatttattccttgtagaatggggccaacatccctaggttctgtgctgaatgatattcacttgaagttttacaatgcagttgtttgttatttcattaaagtagtgcctattcatagaaaagtcagaaaatatagaagaaagaaataatctttgtgctataattcaaagctaactgccattaatatttgcaggtagtttaagtcagctgtgtattcagtgctttgcatgtacagctgtgcaaggagttgtcaggaatggaaaggcactatcagaagtccgtggtgtcttgcaggggcagaccattatacaagcaactgcaggccttgcagtgaagaccaagtgtgacaagtgctgtaacagagtgtaggtggcagggattaattctagctctgggtatctgggaaggtttcatgagctcagtacatttataccgcacctggagggataagtgggatgatgggaagctgagatggtgtgggagtgagggaggcatttcagatccagggaggcagcctatggtgaaggcaggaaggagatttcatgttcagggcacaggatgtagctcggtgtgacttagcaaagaatgctgaaaagtgaagagtaggagagcatattattggcattattagggactttgaaagattcactgatctagcccctgccagaacagccacaactgattaatattttaaaagtattcaatcttccttggcaattacttgaatactctatcatcctaagagtcaaaagttttcctgggaatttgaatgtaaagagttgtcttcttttttacttttcttttggagaaaaacttgaaccaaaatcatggtgctcttagtaaaattggtattgaatgagaagcatcactacatattggactctctggaaaggtctgttggttgagtaagtgaatgaatgtgtgacaacgaacatttgtactttttgaagtcttgaatcataagttgagcatccaggcagaactgtatgcctcagttactgtggacttgaacttcttgatctctctctgacatctgtcacctccacaggggaagttaatatcgaaaccctctgagtccttagaagggaaaagtgaaattctaacgtgagattctaaatgaatctgctttaaaatgctaaacacatatgtactgaacaaggagatattaacagcctttcattttcaacccctggctttctgtctgcatgaaacacacacaaaagtagtgactggtgactatcataattacatatagtataatttaatccttatggtgatgttcattgactcttcccaagagacccagattacattggttttgttttggccactgttctccatatttgggttggttctgttaccagatcacccactggtctttcattatggttaaaatgcatttgagggatcacaaatagggtgagagtggttgggagcaaactcaaaaaatattaaaatttataattggctataatctagtgaaagtgttggcatttctagtgaaatgattatgctggcttcagttgtaattttgaatgaatctggtgatgataataagaatataaccagaatggtcaatgatcccacgatatatatataacatgtaaagaatatagtttaatggatgtgggctttggagtcaaactgcctatgttcaaatctcagctccacttgttactagatgggaaaccttgggcaaattaccttacctcttggtagcattatctgtaaaatgagaaaagaagtagaatctcataggactgttgtacagagtaaattgatacatgcaaagcactcaggacacggccttacacatggtgcagtgcttgtgtttgctgtagtaactgctaagttgaggagctgaggctccttctgcctcattttttatgcttggctttgtggggtgggtcgctgttactgaagcaaagttgccacctgcctgtgcatccttttcagcctggggaaagatttacaccagtaatccagaagtgcaagtcctgatacctttgctcaaaacctgtcccttggtctgcaggaactctgtggccatgattcccagtagaaatttggttccttgtaatggaaacagtttaaaacaaatgtgtcctcagtctgtccccagttccaagaaggacagacggacatttggttttgtgatctgcctcatttctgccacatttcaaatcattaggatgacttcaaatattcgcccagggccagagtttgcaccttaatatgttttggcaagaaacacttggcatttgagtaatctgtgtaaaagaacatccgtgaggataaacatcttttctaccacacatgaacttagaattctttctctcttaaatttccagtcagacattgctaggggagtaagttgggccagatagccagaagtcagtgttaagctacagcccccttgctctaacctcccttctctgtgtcatttctaagaaattgtaattttttctttccccattggcaactggttagttgtcctgtcctctacctattcactgtctcaagactttttcctgcctttcagatttgacttctagtatgaggagacctacgtggagtgcgtccttttccttaaaactatttttaaattctttcattggctgctgtgctatgacaaaaccattttgtttttttaaattcttgccactaatgatgcccttccctcaagggcatactctgagctctgaggtaatgaatgcttttcaggttgatcatgttcatcccttcaggctgagaacactttccagaaatgcccaagatctaaaggaccttggccagtggaaaaggtaaacttcttgaaatcagtggccaagaataggggcagccacatgctctccccctgggatccccaagatagtgccacaactcggtaccattccaccctccactgcagggagagaggagagaatttgcttcatctgtgcagaattccctccaggatcttattcctcccctttctgcccaccccacctctcaaacagaatgattggtgcttaagtcaaagagggtctctctcaggaatgcatgttaatatcagaaaaggagaggaagtcagcccggcagtgagcaacctttacccttacatgggttcagcctcctcagcctgcccttgtggcatcctgggattttggcagccttatgggtatcagattttcacatggatgaactgtactctacaactacttctgtgtgctaggaaccaaaacactttctttgacattgaaaatagagttttctccttctcactgttttggcctgctctgttgcaagggagatccatttttcagggccttgagactcttgtttacctcttctcagagctctgtgtctttgaaggctaccaggaggtagtgatgaccttcggataaagcccctggcagctcaggtgggctgggtagggataggtgctttttggttcaatattttcaatttgggagataatccttagactcttagaaagacttccttggctatttctgggcagtaggcttggacatggaggcaggaggttctgcatttctttttcaaagcaaaggtgatggtgccgtctatggaaacaacttttccaaagaggtccttttaatcatgaggcattttgctgtttaccctccagtgtgtgtggggtgggagcagcttgaacttcacacagaagggaacccacagttgtttccacacagctgtttcctgcattgggccagagcaagtctccgtgtcctgaatatctgcgggaaggatcatctgccacataaccatctgcaggcataagtcaagaggaactttcgaggagccttaagattgcaaatgtaggttttgtgtctcagtttaggtgtgccttgatgcatttcctgtctagcatggacattatgagagcagctgcaaaaatccaaacgtgatttttcagaatttgggttgggggaggtaaaaactcaacctgctcagcccagattgattgcaatgctttacataataattaatgatgtacaagctgttgcctaatgggcagttttactgtgtgtgcccttcagttctgactggctggagttctccacgatttaaggcactacccctttcctttatgtgtcttagcctttgggtaaagctgctgtagtcattattatctttctttggtggttatttcttcttctttttttttttttttctttttgtaggtcattcaatgaaacctatagttctcattgggtacataggtctttgcttcttttcttgaccttaacatttaaagagtgaagaatactttttgtatctgaaaatctcaacatctctgagtgctaggcagtgagcagttgccagggataaatgatgaagaaaataattatcacttcctctatggcaggtactatttcaacactccacatatgttaactcatttaattctcttaactctttaaagtaggttccgatgttcctcccatcttacagatgagaaaattgaggcacagagaggttaaataatttatctaaagtcacccaattaattaaggagtaaagctaaaattacggtgaaagctgcacagtgatcctaggagagaggtactattattctcatgttttaatgaggccactgaggttcaggaattgttgaaattcactcaggcttctcttagctccaatgcaagctcttgcccagtatattctactgctgtctttactgtaaaaacacccttatttctatcccttgcagaccctagactccatttagttgagcaagtatttactgaaaaaccactgggttctaggtcttacgccgggcactatgcatgcagggatgattttttaaaaattttatatccttatgtaggtgagtcagatcctgctgactaattgaattaattttccttttgggggagtccagaagtgccttttggtcttgagtaccgtgctggtcacatgaaagctactcaaactagatactaatatctgttggttggtaaaaggtgatacaggtatgtcattgaacaagcaattttgttctacaaatgtttgtattgggttcagttagttccgtgatgggctaatgtcctacactggcctgattgatgaacccaaataaaacttttaataggatgtcaccttttggttttatgactgtcactttcccatttgaggtagtagactaaacagtttaagagcgcaggcattcagctcttacaggattggcttgagaagctaatattatgttgggaaaattatataactagacatcaggacatatggattatagttccagctctgatattcattactaactatgtgaatattgtcatgtcttctgatgcctaatttttctcataggcaaaatgaggaggttagactaagtgatgattaagatcacttataaaatcctagagttcatggaaaacacataccatgactagtcctttcggtcaatttacgagattggttgttgactgtagataaatcccttaattttgttgtctttgtttttcttgcctttcaaatggctttgataattcctggtgcacctaatttatagaaattccgtgaggatttagtgagatattgggaatataagtgctctgaataattaacgcattacatgaacacaagatgatattatttgtactgaaagttaacagaaagatgtcgagtttctcgttacctccttccttccccctcaaaaaaaaaaaaaaaaaaaaaggcttgagttaaaaaggagtttgatcctggtcaggctgtttcctggagtttatggaactccttggaactctacagggtcaataggggctttgtcctgctgtgggtcagtttcccacagttggggtaaggctgccacactttttctcctgacaacactttatcaaacacacccgcctcacaaaatgcagcaattcattagacaaaagtgaggttttgagttacaataacctctgctttgttaaaagccccctcggaatctgagatcttctccgtaggccagcagacgtgcacatgtcccccggtttacaaaggccttataaacttagcctgataagtcatcccccaaattcgtgtgccatgtctgtctctcagtggggatatttttaactcctccttctaactcctctcagttcctttaaggaactgtaatccgaaagggtcaggcacttggcttttacttaggggaaaactttgaaagaatttctgaggctccctctggggtagggctggctttccccaaaagaactggcccttcagagcgtcttttccacataagggcttgtgtgaggcctcaggcaccagttgatggccgtgtcttccccacgacagatggtcaagctttcaatttcagcaagtgatccactgttgagggggcaggcgggggactctgccagcatgccaagtgacaggccagcttagggtaacagggatctggtgtgtgcccggcatagcttttgtgctaacgatgggctgctgacaggcgccctgccccagctcatctttgaggcagaagatcctctgctcccttgattctgtttctccctggcatagctggtgtcctgtttgcctgtctttcaaaattcattttggcaccagatggaccccctcatggtggctagcagttgtctgacttgaagaagccagagggtgtgctgacagctccttctagcacaacctgaatctggctgtcttgtctgggctcaaatggcttaaacacacatgggcagcaaatattaccaaccctggggaagcaagcagggggccctcttaagggagaatggcaatgacgtctacctccataatgttcatgttgctgttgtggaaatcatgatactaataattattcttagtagttcgattaatcttatttactcttattagcaaaattgctgttacagtacgattgctatcaatagtacaattagtattaacatcattactgcactacttctgtcattactaaaactactacatcatggtggttaagagtacagtctctggagctacactgtctgaatttgagttctagattcacacttcctagctttggacaagttatttcacttctctgaatctcagttttctcatctataaaatgggattaatagcagaggttacttaggaggattgtatgagaaaacagatttgttcttagcattgaactgagcacaaggtaagcacccaatacacggaagccattcttatgatgactgccaccatcagcatacctaccatgtatctgttactctgccttatcgcaattttcacagtttccctatacagtaaggcctgttattgcaccagtttatagataaggaaagtgtggtgcagagaagttcagctccttatccaaagtcacacaggtagtacctgtcagagtcaggatatgaatctcattattctgggtgtttctaatggctgtggcctttcaccatatcacacccactcttgttgtcagtttagtgataatcagccctctcctggggcttgaagtagctttgaaatatgcccttctaactgactgttcttgaaagcagcagccagttttcatgtcttcagtgtctatggatataggattgaaccctagcaagattcaaggatcacaacagtcagctccactgtattaaatggtttctgaaagccatgtgtgatcagcagggctacccagcacttgccttctgggagctcagaccaacaagacagtgcaaaggcacttaggatttgggccactcccttaaccccccttcctttaccaaatctgtcatattgaaagtgggcaagagtcaatgactggctgattgtcctgtgcaaggacagtgtgggtcttggtaccggaaaaggagagctcaaaatcagattttgtttcacacagctgggcttcagtggtgttctgtaagccatttgtcttggacgaaaggttgatcaactttggcttctgtggagagaatctggaagtagcggcaagtgattatttagaggcctgctttcattgatgggcagtcaaatgttgtgtggtgttaaacagtcattttaggacgatgtttgcatttttaaatgttactcttttggttgaaaaggccattgtttgtctctaaagaatgattcccacaacatactcccatcttggcagattctaagagaccaaggagcagagggattcatgtgggacttctctcagtttcatattcagaaattggctgaactctgtatgtcttcgtgcagtgctgttgttatagaggatcccagtgttacatgattgacagacattgcagtcagagccaaattcagactgaggcatcatagggtgatagttcttcataatctatttgtgttgagatggggattttactccagtgtggacttgaagtggaagaaaggggaagagaattgaattacaacaagaattcagttgaccagcattttaatgcattttgatatttttaggaaacatttcggcctgaaatccacaggcacatcacatctaggcctagtagtaaaagagattgcaaaacttaggtatctttggaaatacttcttttcccaaacctgggcaggtagaaggtttaattacaggtggtagacatgaatgccccaatatgacacttttagtagctgctgcttttccatgatagactttaacaactgtgatggttacataagaaataactcagaaagttatagggtgaccatataatttatcacccataccaagacatttttgagagttaaagtaggtactattaatatatacaccagtacagctggtataaactgggatttttcttggcaaattgggacctttggtcaccttagcaagtaaaacccatgaatctcactacagaaccaattcagaaaccaaggtggcagtgaggcaggaaaatctttattcaatcacagctagctcttgtctacagcagacagtttaagaaaaacaggagggcctggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaacaaaaaaaaaaaaaaaaaaaaaaaaaacaggaggtatttgagaagtcaaaggagtttagttagtttgtgaattttacttatttctcatgggtagtactaattaaaacattttacttgagaggctaagataaaaagtggttaccaaatccttgtattcatccagcatgtatttgccagttcatcatctgtgagtttatagggcttaaactgcatgttgtcgttggggaccatgagtaattctcagacaattatatccaattggaacctaacttaaattatgatgaaagctttccctctgtatgagtgaaaatacttccttggggcttaattcttctgtgagatctgttggcagtgccaacagtgtttgtgtcataaggaaggtccagcgtggaaacaaaacaaaggctaaagccacaaatgaaatattggctctaacaccatgctgaatatttcagaaaacatgtaaagagaatcgaatgcacaacccaggggtgacttacctcttttttccctcccgtgtcagaaaccgaaatgctaaccatgatgatttgtttcttcacaggttcttcttgaaatttttcctcaaatgtaaccaaaattgcctaaagaatgcgggaaacccacgtgacatgcggagattccaggtgggtctgacttatctttcttgaatctcaataatggcatgaatatcaggagaggataaaaaagtcttaggcagaagatacgtagctttttttcccagaggtgaagagcagctgaggcccttggtcccccaggtatctgcaatctagcagttgtttagattagagaagagtgggaactgtaccacctgtgctcactggtggaaacaatggtgttctttgagtctagttttggctgcctgagtggactcacttgcctaaacccccacagattaagtaaagtacatagaaatgatgaatcctttgtctaaaattttgtatgtagaaaaccagtaaataagagtaaagaggctgagcgcagtggctcatgcctgtaatcccagcactttgggaggctaaggtaggcagattgtttgagtttaagagttcaagaccagcctggccaacatggtaaaacttcaaccctacagaaaaatacaaaaattagctggatgtggtgaatttgcctgttgtcccagctactcgggaggctaaggtaggaagatcacttgaacccgggagttggaggttgcagctgaggtcatgccactgcactccagcctggataacggagtaagatcctataccccccaccaaaacaaaacaaaaacaaacaaacaaacaaaaaacagtaaagagtacaactggtaaaactgctctgctttacagtaatggctttctcttcctttgcttctctctgctcacctcttccaattttggaaattgttagtggtagctgcctattataaatggccctgttaagaagcataacatctctaaaatgatatggataacaattctgtttcagaaatgtccttaattatacatttactaaaggaagaggactcacaaacaaattcatttacttctaagacacaaaatggtacttggattttagaaaaggttgttgagtctagacgtggtgcttctctgacttaaaagtgctgaaaatcccctgaggatcttattaaaatgttaatagaggtctggggtgggactggaattctgcattcctaacaagctcctgtatgatgccaaggccaccgcccacactttgagttgcaaagttttagacccttgtgctgctctccacctaatggcatggctaagttatttgtatggtcaatgttagtttccctgtcagagcaacgatccatttatgtatgctcatatggtccatcaaggaaacagcatggtgtttaaagtatgctcttaagtatatttagtcagctttaagtgtagattgaaatgtatgatctctgagagaatcttgaaaaattttagctgcaccttcattctctgatgggaaaaaggaaagatgatcttgagcattgattggagatgtcaatatctcttagtctccaagatgatttcttttaaggaggtgagacttattagtcttattaaagaacaaatgcggtagaaaaaagtaatctctcctgagattctgaggtatttctctaaaatcatcttggcttcaccaccttttggcttgacacacaggaatggggatgtttctttttttcttttctttcgtttttttttttttttttgagatggagtcttgctctgttgcccaggctggagtgcagtggcacaatcttggctcactgcaagctctgcctcccgggttcatgccattctcctgcctcagcctctggagtagctgggactacaggcacccaccaccatgcccggctaatttttttgtatttttagtggagacagggtttcactgtgttagccaggatggtcttgatctcctgaccttgtgatctgcttgtctcggcctcccaaagtgctggaattacaggcgtgagccactgcgcctggccaggaatggggaggtttctagtttcttgcaaaatgtttcctccggtcatctgacttcaaacttggtgttctcattcccatagaggattttttgtgttatgtttgagtcaactttgcaattaagctggcaaaaccacacatgtggtgctactaagtgtgtgttgcttagggtcttgcaacatgaggctgaattttggaataaactgttttgtagcttgctttggtcttgacatgaaccttatatttcttttgaccaaagcttgagttaggagcaaagtatagctgggcgtgaaacagtgtatgtctaataaacatgtctaatgcctaatgtataccaggattaactctgctgtacctcttagggcagcagagtttgggatggactttgatgacactgggaacctaaaagagcatccgtgtagaacttccaggggctctcttttctttgtggaacctactagtaaaatgtctgaaaaggttgaattatagaaatatacctgttatacaagatgagaaaccaatttagtctattatttttgagaacatctacaaagcttctattttgcaaacaaaatagttattctttgtttagtagaaaggctgctgagatgaggaggcacaacatagatatctggaaagtcttataatcctttggagcttcagtttcctcaactgtaaaatggaggaaaattgacacttctgcttatatcactacatatgaaagaaagcaatattttgcatgtatagctaatttgtaagtgataaaatacaaatgcaagcctttggagaaaatccatgtgacaaactgaagatggatcatgagttcagtctagggtttctcaacctgggcacagttaacattttagactggataatcctttttagggtcaatcatggggggtgcccccatgcattgtaggatgtttagcagtgtcactggcctctaccctccagatgctagtagagaacatctacctcccaatcatgacacccaaaaatgtctgcagacattatcaaatgtcccctggtggagagaggagaggcaaaatggcccctgactgagaactactgattagtcctatatctgataaccgctgacaagctcttactggtgacagtgccactgtcccaaaaattgcacactttgattaagtgtgagagctgcccagcacaaagtccatactgtctttcaaataaatatgatttatctgaactctgacactgacaatgctcttgcctgtgattctcaaatgggtcctaaaatagatcaataggggcagctaccttggccaccatagagtcagtttttgagttaaggatgagccgtgtcttcctttattaacaatgacaaattccttattgggtctcaggtttaacctgctttgttcccatcacccactctttgctgcctagaagaggatggaggaacccatggcagaatgaacactgtcacattttattttttatccctgtacattaatacatttctttattattttcatacaaccaacattgggtttcatgcatgcaggtgcatggatatttgtgtaattagaggatggatgaattgcctcgagagttaaagcaaaacctcaaatctctctaacccaaccttttattttttcttcttcagtctttttctctttcatgactatttactcctacctctctctgtattatttcatgctggcagccattacaccctttttgaatccatttttttttcttgaattatataacaacagtcactcattctgaactccctacaagggatgctgtttgtttgtcttctgtaaatattgtttttttccaggtctccttctgaagtccagatctttccccattttataggctctctccagtatcttctccagtcacagcatcttaaccactatttatgcactgagaactctggtatcagaatctctgagacctgacacccaggtttagatctaactgtccagatgtctgctggatatttccaggaacttcaactcagtcagccccaaactgaactcactgtcatcctcaggtgtttttctgtttgttcgttttgcctccaccccaagcttcttaggttctctgtcttggttcattcctaactgcattaaatgctgggaagataactgtgtctatattcagcatgttccatgttcacgtgtataaatgcatgtgtccatgtgtttacctttatgtgcttctatcgatattggtagcgatgatgatgataaagctaacatttatttggtgcttctttagtgagagacattgtgcaaagtattttacatgagttatcatgtttatcttcaaaatacccttattaagaatatggaaatgtggattattcccatttttaaaatgaggaaacattttagaacagttaagcaatttacccaaagtcacacatcaactaaatggtaaggcagtggtataatccaagcagtctgactcagatattttctgatgttttggaacaacaacaaaaaaaaattgtccatagtctgtgagcagatatttagtgaggctataaagagatctcgtaacatctgagagccctaatgaccccccacaaatatgtgctggaatcccaggaaagcctgagaggggtcttcaaaagagatatttgtcctagcagagcctaaaggtgccatctgcatgaagaacattgacacacaatcaaagttcatcatgcagagggtagagttgtgtggaagtgaggaaacatgaacatttttccagagtacagctacagtgttgatcaatttttacttgcagggactttagaaaaacaagctattatttagcaggtaacctgaacttcacttaacctgtaaagggtttggtcaattctccaaggcaagagagctcctcacctagatggggcatgagtaaatcaccccgaagacatctcagagtagtctgctaagaaatcctactaaatttcccaagtcttaggaccgaaccaagacagggaggattagtctttgctgtagctgtcctggctacagaggtgtgtgtcataatgatattggttgaagattgcttatgagtaagacctatactttttagcatttttctcatagcacactaattgggaggctggtttcaaatatttttatgtctctgttgcctctgagggtgagtgaaagagtgtctttctggcacaaaaaaactctggtctcctccttacatgtcaatgtggcttttaccagttttattgaaaacctgagtcctggcacatctgactgaagacaccctctcttgcctactaagcagggtctgtgcagtggtcactgccgctgctttcctccatctcactttgtatgcttgccggccagcctgatcttcatatagcaacgcaggagcgtgtctcctctgaacagcaatcaggggcctgtgtaggtgactgaggaggacataagaaaggttgttgatctcttgacatggaaagacattctgtcaagcaaactcagcttcacagtggctgggcttctgctgtgtaaacagagattgcttaattacacaggtcgtgtcaattagtgtgaccttagtgttttcaagaaattaatcactttctgcagagctgggctgtgttcatactttaaggcagtatggaataaaccttgtagaaaatctggcacaatgtttttttttttttaatttacaatggatgctttcttttgaaatccctaggctgtagttagggtaagaaatttgcttaaatacaacagtggatacaggctttgttaaggactggtgggtatgaggaaggctggaggaaagagaaggggagcaagctggggatggaaatagctcacgacacagggagaaattcacttatgactaaacaatcctatttcttcgtcttgacactaaaaagatgctaatgtcaaaggactatgttaaaaccatgcttcggtctgatttttaaccgacaggagccagacaattcaaccttaagatttaaatttttatcaatagctttccttttggggactggcagaatgagggtggtaagggaagaacaagaatcaggttcaagctgtcattgcaatagataccataatacctggagactgaagtaaagtataaatttccaaattcatcttatctcttcaataaagtttttccattggctataaatctatattcacgtataaatattagatctataactatatatgaatgtaaatagaagacatagttatgcacacatgcaggaatgcgtgcattcagtaatatttattgaagtgctaagtggtgagtctatcatgatgaataagaaagataaggtctttgccctaatgaaacttatattcttcttgggatgatactagctcttgtaacaaatagaacatataatatcgaatggctcacctgcagcagaaggttatttcttgctcacataatggtacaaggcaggtgttcctggttgacgagcaggtgttgtccttgaggttatttggggacctggactccttttattttatgcctctcctattctacagaaccctgctgtctttatccagtcctctgatgggagaaggacacatgaagggtgccatgtgctttttaaaagccttggcttacaaatttgctcacttccattggctagaagtcagtcacatggtcatatgcaatcatagggaggcttgcatggtctagctgtgcagcccatgaagacaagaaaatggatgtatgtagaataattgccattagctgcaatgaagatgtgtacaaattaacaattacaaatattagaaattgtaactgctgctataaagaaaattaaacaggttattatgagagagaaaaacagtgtggggtgggagatgaaaacctctctttttttcttttttttttttttgagatggagtctggctctgttgccaggctggagtgtggtggtgccatcttggctcactgcaacctctgggttcaagcgattctcctgcctcagccttcagagtagctgggactacagtcacgcaccaccacccctggctaatttttagattttttttttagtagagaagggagacaacctctcttaaagtaggtgaccaggaaagcgttctgaggtgaggacactcaagttcagagatcaagaataaggataaaccatcctgggaagagccagagagggttctgagcaaagggaatagcaaacacaaaactcatgtttacctcatgtttatctaaggaggcaaacaatcttgcctcacatcttagtcatttggatagtaaagaagaggagaaaccactgggttattcatcccaaattcccaccaaaaatgtgttttgctttttaaaatgatgacatgagttatgacattaaaaggcaactccctgccttttcaagtaaattctagaaattttggagaatctttgctgtttgcttaacaagccatggtatctctggatccgtatgttttagggaatgattagaggattcttaaaatacatgcctgacctctgcagtttctgtctgctttaaatacacttacataaaagggataagaatatgtgcttctttatttctcctccaccgactcccagcccctgtcttggatgtacttatattgttatattgttttgacaaatagcacatcttgcaattaaattctctaccaacagaatgctaggggcccgagctgcgatcactctcttcatacagaataatttcaagaggctccatgctgattaattatactgaaagcagctctaatgatagtttcagaatacaggattaagtcacataacatggtaaatacaaatggtgattttcaacctgatatattaaaccattatggcttattgggcaaatatgtatcttggcatgagccttatgctgagccttggcagaaagtgtgcatcactgagaaggaatctttatgaacagcatttgatgagtggtcgccctgcacttagagaacatgtatttctacattaaacacagctgcttttaaaggaaatgtaaaatacattaaaggatgaatgtaaaagtgtttggtttgatcagtgattaccaatggatgctggctctgaagatgcctatagttgttgggatttaccagcaaaaggtatccttatattcttccactttttaagttgtaacttgtagagctctagttatatgtcagacaacatactaagtgttatacatgtataatcttacttatttttctaccactttttctcttgtttgctttagtcctgtcaagcacattggccttccttcatttttcttccccacatacaccaaactcattcctgcctcaggatctttgcactttctattctgtctccctggaaaactcttctgacacattgaatgactggatattttttattcagatttcaggctgagcacggtggctcatacctgtaagtcgagcactttgggagtacgaggcaggtggatcacttgaggccaggagtttgagaccagcctggccaacatggcgaaaccccatttcttctaaaaatacaaaaaataaaatttcctctttttttgtcacttccttaaagaagcctttcctaatcacccaattaaaaatatctcccacctaggaatcatctaggtggaagatattttattttttcttagaacttatcacaatctgaaatttgcttttattgcttacttattgtctgactctctctctgtccccagtaagaactaaactcctgcttggtaaatgctttatcggttttgttcattgttgcttcttcagtgcatagaataatgtttggcacatggtaggcacatagtgggctcaccacgtattcctatgactaagtgactcatctaagattacaagcaagtaagtgatgggactggggatcaaattcaggatcatctgactctggaatctgagccattgaccaatatgccattttcttgctcctgatttccatgtccgtatgccatagccccatcgttacagagcacacatgacaatcctgtttgtctcattcctacctaaaatggccaatgaggacacacacacagagagcaccagctaaacaccaatgacaccctcaagagtagtcaaaagtatcctgatccacagagggaggaatgaggttcagatgacttgtgagcttttcatgtttatcatatgtcaccgttcaggagacagaagctaattctagtttccaaaggtctagattagcttagcacatgtatctgaggatttagaagtgtctgttcttgtcttcctgttaagagctggttttgcctcaagccttaaagtgcgaatgtaattccattaaccactcctttactccagcagttccactccatgacatcctgtaggttcacgcgtcctccataatttttaatgagttatttggaatctttcaaccagatagaagctagcaatcaggaacatttctgagaatatcgcattcatatcagccaaggatattttaaaggacaaagttaatgaagacctaactgctgcaaactatttttatgtaaataatactcaaactgtagtcggtcacacaggcaccatagatttgtactggaagtattaggagagtccagagagaggatgtaagccaggactgtgtactgaaaggccagaggccaactgtgttggcttacacctgtaatcccagcacttttgggaggccgagatggacggatcacgagctcaagagatcgagaccatcctagccaacatggtgaaacaccgtctctactaaaaatataaaaattagctgggtgtggtggtgtgcccctctagtcccagctagtcaggaggctgaggcaggagaattacttgaatctgggtggcagaggttgctgtgagccgagattacgccctgcagtccggcctggtgacagagcaagactccatctcaaaaaaaaaatgaaaggccagaactgagggtgggtgagaactgcactgtgagtctacaggtttcccttcaggcttgcctctgctcttaatttgtcctatgatcttgaagttgtttttttaaactcctgggccttagttttccaagctgtaaaaggaggtgttggacaaatctggactgccataacttatattgaggactccttttatcattttctcctatgaacctcctatgatgacatatttttcaatcaaattgcatttattaagaatcacgttctctttagagttctttaaagccatgtaaaactgctagttgagagcttctcatgtagatgagataaccagagtttccacatggagttgatagggtcccagacaagggaaagttaactgaatatttcagtatgcagccttactgtggatgcttttatgattccctctgtgcaataatgtcacccattattacagtcaaaaactcttagttaggagccactagattagctgatctctggagtctcttgtgactctaacatttgacgagtctgcaaagtagttcagctgacaggtagaatgtagaatgtagactatagggggttgagggtagaagtgtgatcaataccttttaaaaaatatagagagtttattttgtagagcagttttaggtttacagaaatataataccttctcaaccccatccccatcccctaacccccagtttcccctattattaacatcttgcattagtgtgatacatgttacaattgatgtgccaatattaatatgttattaaaatccatagttttgtgggccgggtgtggtggctcatgactataatcccagcactttgggagactgacatgggtagatcacatgagcccaggagtttgagaccagtctgggcaacatggtgaaaccctgttttcacaaaaaaaatacaaaaaaaaaaaaaaggctgagtgtggtggtgcatgcctctagttccagctactcaggagctgaggtgggaggaccagttgagcccgggacgcagaggttgcagtaagctgagatcacaccactgccctccagtctgggtgacagagcaggaccctgtctcaaaaatcaacatcaatttaaagtttacactagagttcactgtttgtgtgtacattctataggtttagacaaaagcatggacatatacatcattacagtattatacagaatggtttcactgctctaaaaatcccctatccttcacccattcctccctctcttctcccagactcctggcaaccactgatcttttcactgtcttcatagttttgccttttccagaatatcgtatagttggaatcatacagtatatagactcttgagattcactttttcttatttagtaatatgcatttaagacccctctatgactgtctgtggcttgatagctcattttcttaaattgcaaaatgatattctattatatggattaccagtttgtttttccattcatccattgaaggacatcttggttgccaatgccttttatttagttgagatttttattcacataattttaggtttacatgcagttatagaagtaatacagaatgatcccatgtacccattacccagtcttcctcagtaacattttgcaaagttattttacaatatgacaaccagaatatggacattcatgtaatctaccatcttattcaggtttcccttgttttactagtacttgtttgtgtgggtgtatttttagttctataaaattgtatcatgtgtctagctttgtctaacaccacagtccttatatagggaattttcatcaccacaaggatccctcatcttgtccttttttagtaatcatactcaccttctctgtgtgtccaaatttcctcctgtgaggattggattagagacctctctaatggcctcattttaaagtaatcaaagccctatctgaaaatacagtcacattctaaggtactggagatcaggccttcaatgcatgaatttctgggggaggaacaattcagcccttaacatgcagtatgtatcccctggttactggctttttaccctcaacataattccctgggatatcaatagtttgttcctttttattgctgagtattattccatgaaatgctgcccagtgcttttcatttagtgtacttcaagttaatatttttaaagctttgtgattaggggccctaaattaatgcaaaagtacaacaagcaaaaaacagagaggttaggaagcatagaactgactaactttaacactgatttccttttactgagttaccatgtatcagcactgaaaaccaagatttggaatttttaaataatcattcaaaattaacgtgaggaagagtttattttttggaaggaaatacttaactgtcacaatattctaaatttaaatttcaaaaatatatttatggtctaatctttgctctgattctgtgtttgttggagaaatgcttaaagatacaaatttcaacatgttgggttgcttttgtcataaccccttcttccccacaaactgctacttttgttaatgtgatcttccactcatgattgaatttagctgcttgtgtctttttgaaaatctgctcatgagacagaggttatgcttcatgaatcttagataatagagttaggacatacaaggtctcctgcctgacatgaagggaagaggggctgcctgagaagtgatggtgaggaagtactcaccaataacaaaactcctgagaaatcctcattgatgggaaatattgggaaaactagactgaactgatgagacatctcatttacagactattttcagaatagtaaggtttcatttagttataataaagcctcaaatgtaacaggctaagatacagatagggtctagaaagcgacattatataaaccaatgaaaaccgcaattcatgcaaggcctaaatgtgtaataatgtgttactagcacaaaggtctttaaaattgtacgtttgtgttgagcagtggacatagaagaaacactttctgtatccttttatttaaaattacagtgtatgctgggtcttctttacggtcattaagatacttcaggttatcaacccgacacattcttttgaacttcttgtttaacatcacccacaaattgacaactactactctattactgctactaatgtttattgagtgctccatgtgaaccaggaaccatgctggccactttaattaatttaagcctcacagttaccttatgagttaagtatggtggttattcccattgagagtcagggacactgggactcagagaagttaacctggccaaagtcacatcaaccaggaaagcttgagagccaaggatgaaattttgtgtctagttctttcaaattctaaatagagggggattggaataataccttttagggatatctatccagaaaaggatataacagaggagattctgaaccactgatatgagccaagaaattgaaaacatcagtgtaaaatatccaaagtccatgggtagctagaaacttcttttttgcccttctcgttctcttataacgaatactctcaactagaaaggaaggcccagatgaaaagtaccctggaacatgctgagtgttaatcagcatatctctagattgccacattaagaagcaaagccccctaatagaaatttcattccaaaaatatagtgattaaagcatatatgtataaatctaaacctgtttacataggctgatatttatttcaggagatataacttggacatcttcaagaatcaagtgcacaatttatttcaaaaccattctagagcagtgccatcctatagaacattctgcaatgataaaaaaattccctgttcaccgtgtccaatgcagtaggcaatagtcgcctatggctatgaaacgctcagtgtggctattgaggctcagaaagggaatctaaaatgtcgtttagtttaaatttaaatagccaggcatttggcttctgtattggacagtgcagttctagaaagtaaaggtgtaattataacagatatcgtgaaattctaaacatatcttttccttcgtattctcatcatctgtttctctgggcaggggagtggaaaaggggagaaagaaggaaagtgttgttgtgtccaaaggtaaaatcatttttaatgtttatctgtctcaaatttaggctgtgttttattgacaaaatttaggaaggttgaagatttggcaggcttgtctgtccccttgcctgtgtgaatgtgtcagcaccttattaattatgtggtaaactgtaaaggcccttttccctcctaccatgggcctatttttaaaggacacttcagtaccccttttgcatctcacagtgtttttttttttttaatttacaagtcgctctgtggattaattttagcatatgttttatttaaatatatcctgaatatttccaaattgaaatgggagaaattgttttgtggtagggaagttgtgctgtgagtttttgaggaacgtattagctgcttattttctagaaattaaaagtataaagattctctgtattatcttttttccaattttgattggcatttcagccaaatgattctatcacacatgtggccctggtggttcttctcttgccaagaaaagaaaaacatatggggtgtagtttttttttccttaaccgtttttgacatttttgttcaatgtaggattagatgacagtgtctttgaaacatactgaatattttaagccttaagtttgtagagcttgtgtcttacaggtgcatggtgaattgtcattgttttttttttttcctcctaagacagacatctagaataaccactttctgtatttcctgacactgaaaacagatatggtttgggattccttttatagtttcttcagctaacgactccagtgaccgctcaattgtggtctcatagtaaatcaaaatttctttgaaagacccagctctgttatgtaattgtaagtcctaagaagtcgtctctctaaaaagaaaagtgaatttctgttgccttaaataatattgactttgccactgcatatgatagtttttgaaggcaaaatagtagaccgttttcttctcttcttctttcttttaaattaacctgtaaacatacaagctgtgtttacacataaggctgtgtcagatctggttggtcaatcatgaataaagagaagaaccactctgcaaacttctgcatcaaacttacatgtcatcccccaaatgatttgttctagatggaatttggggtttcacagtggctaaggagaatactctgattccctgattgaactctcaactgtttcctatgcattttaattaagtagatttagaaaacaaaatcaaccttatgctactagtatgggtgatgtgttcatagcctgcaattcgtgggcatctttgaggctctgggaaaggaaattcatcgtattttgccaggatgcacttaggtcaacgaggaggacagtggaacttttaagtatgggaagactgtggggactggcgtccaagctgacaattcacaggcataggccagggcctggcgttttcccctctgcccagcttagctgatgaaagagtgttacacaagactcttcagaagtcgatgcccccttcagccaacttggagaaaaggcttcctcagaaactgaggcctccatctgtgccaacccttgtaaagcggttcacctcttcagaggctaatgcctctcaaaaccaagaacaattaaagcgagagtctttccaagcaactggggaattgagcaaaataaatcagaaatcctcagccttcgctctggaggctcgcctcattatgagagcagatctattagccctcttgccattgtctttcatttctcaagtgaggtgattctaattaaattaatctgcatgtcaatctatcggtgatcaatcaaagagcctgaggtttcccctatgctgcagggtgcttgcggctgacaggggctgataatggaggaagaaataaactgtcgagcaaagttaattagtcaacataataggtggattaaacgggagcgggctgattgctgtttcccatgtcaaagcatgaggtgggagctgaagctgcaattacagacaattattatatttggttgtaagaggtcgcatgaataaacatatctctgtgggtttcagttttaatccctttccccatttaatataaggagaagcgtaggtcatttcttctcattgttttagtcaaagttctctgagacaacatctttgcctgtgtctcttctggcaaactgggttcacagtcactttatgagatggtttcagtgtctaaattatgtcttgggccattcccaccagttttttttttaatttgaaacagatctaagacccttaattagcaggaattttttggggtggggtgatggtaatagtagtgagggggactttggtctgatgaaccaaactaatgtggaaagaaaaacgtacaagaaatctcaaaaagacatccaggagagaaaaatgcatccctgctcttactgaaatctttttcatttctctatcctcttaaccctgacacagtggggagaaatattttaaagattcaaaagatttttatttgcatgatcaactgtgatatatgcttcagtgtctaaactgaagggtaatttaggtgaaacacaaccacccttgtgtaaaaaaatatgctaataaagatcctcttgttaaaattatggttaacagtgtaccttctgctgtataactataaactgtgcaattttacttaaaactgcatcaaaagcgttccatgccaaagacccactcatcaatagctcctcttgttagacttgtacagcataagcaccagttattatgtgaaatagctatgcaattttcttcagctcccagctgttatttatttaacttgagtttattacccaccacgcttttatattaaaatgttcattcatttctttcttatgtctccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatggtaggcgaatcattttcattggttggcattgctactttaactgtgaatatatttggtttctttcttccactccaccacatgttctattctgtttcaaatttcaaaagtctttttgaataagattggtcctctagggttttttctcttcaacatatggtggcaaatatttaaagacaggaaaatatctctgaggcccacctttcttgtgggaccactctctactctggaaatggctgatattgcctcctttcaggttgagagaaagaaggaggcctggaccattgctttattctaagctcccactggattacaaaataaggaaaggccaatccaagggaaaaataaggaaaggccacacaatttggtatcactaaaattgtgatatatttgacatgtttataattgaccattgaggttttataatgaacccatcctctttaccaccctcctggtgtatctctgtgaccacctgttgaacttcatttggagatcaggttcaatgtcgaggttggaggtgctttctgaatatgaagcccagaccaaatgtccctcctgtgccctgtacctaactcttacctcttcaccatgtgatagaacttgctgtctgtaagtagactttggtagggagaaatcccatttgtcttgagaattatggctaatcagtggtgcctttgagaggactgaaggaaaccagataaaaatttgaatcaaggaaagtgaatgccactcagaagaaccatgggttgggttaggggcacgcctgaatttttcagtgctgcatgtgtgtgtgtaatatatccactcttcctcctctccactcatccatccatccgttcatctatctatccatctatccatctatccatccatccatccatccatccatccatccatccatccatccatccgtccatccgtccatccaagaatgagtgactgaggctctgctggataccagtcaccatattagactttcttcaattgcctcaaactctcaacccatttccctcacttccctttccagtttgctagggtcagcaagattcttttcagaacactaccacacaaatgatcacctgattgcctgcttttttccatgggccaggagttgcccataatttacaaggtagaaaactcccttctctgccagcatcccaatttaataaacacgccactctcatcatttttgcctggctttttcccctgtgcttatggaacacacgaactgtactttttattaattagccagatgtaatgctcttagaagggattcttcaccacatccagttttacagtctttttaaagtaaaccatcatctttcaaaagctgcttctttatggtttcattagtgctgagatggatggatattacattttgcaggaggccatttcaaacacctgctcatgattacattcctagttccatttctgtacttaaaattattctgatcctcactttacagtaatgttgtctttataatacccttggagtcacttaaggcattgtgtgactagaggtgtttaggtgaaaggaggaagaaaaaattagggaaatactcagtgggcatgatttggagagtgctgcttaaggattgaagttatgtttttgactgtgggtggttagttgcaataggtactgcccagtctggtgacagacttgactgtcagtttgaaatctgggttcacactttcaaaatatgctcaggccacacccagctcctatttctgctcttgggaagccagtgagaaagctcctgacaccaggcaaattatccctccaacaaaaaccaaaagcaaacatagaatatagccttctctaaaggatccctctaggcaatgaggatcagtaacgttattttgcagcatgataaaggactaggtcttgaaataggtaccaggaaccccaaattcaatttagtttcactctggcctctatttgaccttggacaaatcgctttagcttttgggatccttgatttcctccttgttaaaatgaaggtgatgatctgtaggagagtttaaaaaaaaatctgtgctttgggtgggggcaggtaatgtagatagggaagtgggctgggtggaggctgagaagacaggcaagtacacgctctggtgcccctcggccccagccagttgttgctaaggggaatgagagcccaagtggggccagatgttccagtttggcaacagtgaatttttaattgttggtaactaattacaaaatttttggacactgaagggaggagagggggaaaaaagccacttaggaagaatgcagccacaggtcaacagtttgagacctctggatcaacacagctctaagcttcctcccagctcagatattccctcttctaagagtgttaatatttcagttggggtgtcatattattctaagttttaaagtcagcattttattcacctgcttcagtttatgagtccacagatggccatattactatatttttcaaaaaatggtgacatttcactgtgtaagtggttggccatccttggggacataggtatgtcctatttccttcagcaaggggctttgccttcaccgaagccttatttcacttctctccagtggaaagaaagggtagacatgttcaaattcttagtaatgacaatagcatagaaatctgcttctctgcagagtgagtcaaccaaccacacaaaaccacccactcatttagacacttcaggctgacacataaatatctactcagcaaaggatgactattgaactctttcattggtaatgtgtgggagtggacctagatgctaattcatgttgatgtgagggtaatactttattttgctgttgaaaagtcctatttcaaaatgctctgtttaaaagactttgagaatcatacaccctcatccctctgtgtctccgctcccaccccccaccgccttcaaacagctaccgcatggtgagacggcaaagcatgttctcctcttgtgacctgtgggaacctacgttctcccccattctggactttttaccatctaatttacaggtagcctgaattattttgggctattctgcaaatctctatttatatcctgcttgtcagactgttggaggaagtttccttttgtggctcacctttctgtgtataagtagagacagagatcgtgctttacattcatgcatgggctttcttatgtgacccatggactcgcaaacccctgtgctctgataaatgaccctgtaattcaagtatgagagttgacaaaggcaaatttatttcatagactcttgcatggtccaaagatagtgaatcctggcatgctatagatcgtggaaaatggtcttcccccgtactttctcttcattcataaataccaagattttctttggctggatatttatgggaccatttagcctagtgaggtttcttctttaagcaatagctttatggaagatgtacagtcgtggagacaggcagcctcaaaatgtaactgctctctcagttccaatttttgaaaaagcatgagctcgggatgaaaggagctgagtggctgccacaaggctatgttcagcgctaccctgtgtacttgccttgtcttccagtcatttgggcaagttcatgaagactgtgttctggggagtcattgaggggcctgaggagtgttgctattggcattgttgttcccctgagttccaggttgtgtttacttgaattcaaggccaactgtggcatcagtttctctgtttcttccccctgtggcaaaatgcggtgccctcacaacactgtggtgcagagcccctgtcagcttgcatgcgctaacactttattatctaatgatctaatatgcaacaaggcaaagtgcccgtgctcatcattctgacatagaatgccgggagaagtgactaaattactttatgtaccattagcgcttgcagctatggtgaactcacaggcagcatttatgcaaatgcctgtgaatacactctagtggctttgtcaggaaaccatctgacaagcagtttaaatgctcatttttttaaaggggatatatgtatttttttattttggtgtgcatgtgtttttctcctttcctctcttctttttctttcccttctcccctttttgggcttttggaggacttgcctcctccatggtgactagagaaatgtgagcacgttctagagctcacccaccagtaggagccatttccaggagtgggattaagtccccagtagggtattctttagatctagtttttttttttttttgttattgttttgaatatgtgcatccttcatatttatttggaaaaaaaaacaatggaactattagtcaagagtttttagaatataaacatgttagtgttcatgagctctgacctggggtcctacttatttttttagattgaagatagattctttaaaacatactcagtttttaaaaatggaaaatgattgaaatttagcttttgtgggcatcagatacaaatcaattaaatttcccttcaaagttataataaagactgcaacataaaacataaatgtgccaagatttcaagataaataaaaacaatagtggagtttggtcacactcaaagtattttgaagaataaatactgatgatagactcactgggcccatctcctggctgtaattatagctttggagaaatagagtcaggtgttcaccaccaccagtgaattctgaccttttggttgcagtgtcacattacaactgtccctgacaatatggtggtgttcttgatctttagcatatgaccttctataatccttttgatccagacagaggcagtttttgcttctgtcagttgcccctgggtgtccagcaccattgacttcctgtgaccagctgcatttaaatgtgtttttcatttgtttggtttttttgtttgtttgttttcatgtttttacggaaatgtggagaaagatggtttgagcttggagagactacctcaaattgagcctgtctcttttcccttctgtataatatggtcctaacaagaggatagaaggaggatcaggctctctggctgaagtggccctgggaaggtcactttgcttctgtgggcctcagttttgtatgtccagtgagagccaggtggggtcctctctaggcttccttttagcatgtactattttatggtgctctgaactaaagctattggcacatgactttctgcaggaggtgactttggagaaatagagcttcctgggaacagagaaatccactggcattttctaatagaacccttcctctggatctccagccaagggataaggtgtcaataaggtggacttgaaatcgctcattcatactaagcaggcactacatgccagacattaagctaggtgcagtaggataatgcagactcagtccttgtcttcacagaatatatgatgtgaatagagaggagaggtactaagcaaaattagagtggtgcatcaaagggggaccacaaaagcagaggagagtaatgaagtgtcagggaagccttgtttcaggaaatctcatttatgccaaaaccgaagagatgagtaggtttttactaggtgtcttagtctgttttctgttgctttaacagactgggtaatttttgaggaaaaggagtttatgtcttacggttctggaggctgggaagtccaagggcatgatgccagcactggtgagggcttccaggctgcatcatcctattgtggaaaggtgaaaaggcaagcaagtgtgggtgaagagagctcacttttataactaacccactcccacaataatggaattagtttgttcaggaaggtagagcccccatgacctaatcacttcttaaaggtcctacctcgtaatactgttgaaactgcaattacatttcaacatgaattttagtagggacattgaaccattcatctattcaaaccatagcactaggcaaaggggacaaaaaaaaaaattgccaggtataggaaactgtgtgcaagggttgttttgcttaggtgaattccaggaacaaaaggagactgagagggctcctgttgcgcccaggcaagggaggagtggcaggagatgagactagggtggctgtgagggctacatcatgcaggccaaagtgggctggtcaggccatggtcttggtggcaattgcgaagtggggaggaggtcaagcagggctttgatgaactcagtttcaattacatgggctcctcagatccggtgaaagcccagggcaagtttgctcagacctacttataactttgctcttcgctgctggactttggaaactcaccagggagttggctgtgctttggagctgtccccctaattactccttattgtatcaatagggcatgtgttcttcatagaaagtcaaacattttaagagtcctttctcctctttttttttcagatggcttcgtattattgatttagtttttcgtaagtggcttagaaagagtgtaccttttggcatctttttaaatttgtggagaccctcaccttttcatggtctttagagtagaggactgctgcattatttgacccattaaaatgtatattaccccaccaaaacttagtgagtgaaaataaactaaaacaacagagaaaaatataccctcccaaatttctctctcccctcccaccaggggcaatgcctgagccacagctcacactgagtgaagtcagtgaaggatggaaggtcatttctttcactcttcctcattttacagagacccagagaggggatataatctgctcaagcttaaacatagcttgtttctctcaaaatccattcagcactctttgtacttgtccatgtgcatttcagggtttgcatagtttcctggtcactggataaacatgccagaggatttggggtccaccccaatgcctatccatttcatattggcctagccttgcctccagtctttctgggattcccaggatgctgagaagaatgtctgtaaaataaatccagcttcctgacagaaatgtacattcaagggcagatgatggatgatgcatagcttcccacatagccaacagcccttctgtggctagttttgatgcagaatcccagccaagcccactaaggcaagatcatcttggtgaagggcccaggctaagtagaaaaatattggtgtcatcttttgtgactgagggtggcatgttacaatttaccaattgatttccctatttgagaaaagaagacaggtgtaagagcaaaacattagggctaagaatatccagctgtgtcataaaatagagcactgagaccccagattttcaggtatcaaatcagggcttttactttgtgcagttgagaagatgccttttgtctttccttgaaatagaaaggatgtggtaagtggtcaagataatgcacaacgatgtgagtgaagactgatttccagtgtattccctgagtaattcataaagcaggtaacaccggaaatcctaacactggggatatggtagccagcaggatctcagcatcagacagactgaagggttcatgagcaggtgatctatgttctgctcatttgaccatggcaccaccaatagcactgataacaaatgagaaatagtgctcagacttttttgccatacttgacagtaaccaggccaggtaataatatttattactctattattatttactaccactattgttgtttttttaaactattagcatttatggatcatttactatatatgccagcaccatgctaactattttacttatcatctcatcaagtcttccaacaaatctcatgatatataataattattatcaccattttacagatgagaaaactgaggtttagaaagaatcaataacttactcaaagctgcagaactaattagaattggacctggaatttgaccttaggtctgcctaataacagtgctaagaataataacaataaacattccctgagccctactatgacaggcacagagtgctataggtaccctgttgtaaagaggagaaaaccaaggctaaagagagggtcaataactagcctaaagtcacacagcaattaagtagtagacccagggttcaaatccaggaagcttgatgctgaagtctgcactctaatctactgctctgttacattacagtatgagaaattccttccatctcctatcctattgttcttatttttttcttaacacaagcaaggcaattgtgctggtatcttcaacagacttttcaaaagttagcccagagcatatctttttaaaaaatggggcacatcatgtatatttactttatagttgattttccttcagaaacctgaaggaaatttttcccatggctgggacacattctgctagttgaattttaaaaaatgctgattttattcgatgactagtatattttctgtggggctggcaagataataaggatgctggtaatattttatttatttgcaagaatgtcctaactcatctccctagaaatcatttgttgaccatatgggctctctggcacgtgtacaaggtgtggaggaaggagtccatgagaaaatgatgagatgatgagttaaacaaccgttaggatactgaagagtttgtaaacctcatgctagaaataacatgggaaaccgatttggatatagggaggctagtttcttatatgaatttcttgacaaacctgtaaactgtgggaaatttccagtatttggttggttgagctaataaatgagtgagtcacaccttactaattttaataagcacaaagtgtggtgtgttgtgtgttgtaggggagatttggggaggaaagattgttgctttctacttatattttggccagaaatgacaggactttatgtaaaaacttttttttttatgagacagggccttgctctgttgcccaggctatgaagtgcagtggtgcaatcatagctcactttagcctcaaactcctgcactcaagctatcctctcacctcagcttcccaagtagctgggactacaggtgcactccatcacatcaggctaattattttgattttgtagagacagggttcctatgttgctcaggctggtcttcaatgcccgggcttaagcaattacatccccttggtctcccaaagtgctggcattacaggtatgagccagcctggtcagaacttttttaagcctaattttttttgtcttatatttggttacaaaagcatcataattccaattgcattgatttgcctaattgattgtttcaaaccaagctgtctctatacttatctgtcacaggagctcccctcacttgagaatttcagaggcttcaaatgatgtttatgggcaagtggaagctttgatgtgctgttcataaacccttcttaagatgagatatttagaagcagtggccaggggttgattttgaaatatttttgtttgaccattttcagttatatgtgcagaaataaattaaaaccaagctctgccactaccttactacatgactttgagtatgtactttgatttctctgggcctctgtttcctcatcaattaaggtgggtcttggaagagcccttcaagctctgatgatttgttttttgaacccagctaattctgtgagaggttcttttatgtcttgaggggctacacacctgcagccttggaaaagtggctaccaaaatgcccaggtgaaaggatccaatttccctccaccttggccatctctgcaggaggttaacagttggttctaggaggcctggaaaagccatagaaatgtggcatacatagccattgtgccttaggtagctctcaccctgcattcttctccctggatttcttcagctgggaaggtgttgtgtacaagcggcttgatagtttgcagtgagctttcagaccactatttcccatgcagtaggtgagataattttagaaaatggaggataaacatttaaacatttttaatggttgtgtgtttatgttaatgcgtaaacaaaacaataactccaacttcaaaatcatgatctcacagctattattgcttagggcaagactaaagttaaagaaaaagttgatctaaacaaacatagcagctaaatactattaagtaaataatagtgtaagtggtacagggatagaggaaaatcaggactgaagtttgggaaatgctgttagagagggctgtaagggttgggggaagtaataattctttcaagtcaccaggaaacagtgtaggaccctgggaaacattctttttttgagtcaaatcatttttaaaagaaagtcctttaggctcagtttactgttagaatagacttaaatatcctaacaggattttaaaaaataaaactcccaagctgctgtttttttatttttaaacaagtagggtctgcatgtcagagagcagaaattagtttggaaagaggacttgcatcaggagagaaaatcagccagggtccacccaggcagcgcattatgataatacatacggaaccagctggacactgagcaaggctgacattgtgttgtcaagggcaggatcgcccatcaatttctgagatagaatttgagttcagatgacagaaagagcagcaactgtgttgaaactgatgcatgggggaggggcaggcaggcaggaaccaccgggtctaaaggcaggaagtcctggtacctccggaagggggtggctctgttttctcatctggctgctacccttccttctaaccttaacatctgtcagcaagatccacctgggtccttgcatgattagagcccactaaagggggagcttactggtgctaattttaacccccaagagaatagagtgcctgctgctgaaatgggggctaggtcgacccaggaaatgggactccacgtagccaccagttgtcaacctaagaagcccattgtgggtgtagtggcaattgttaataacttttggaagaattcttaacttttcagctactctgtttagttccttaacatcttaataacaccagtgattcctctttagttcatttgcttattcattcaatcattcatctatttaacactaacacatgtttattgactgactgccaattatatcagacaatagggctacagaggtgataaggcagggacagttgttagcattatgacgtagactgtcacatgagtgtaagtatttatgtgccgatattagacaaataatggcacacggaatgatttaaactgcaatgatggttaagtgctataaggtacaaatacagactcctaagagagcttagaactgggggactcagccaagtctgaagaatcagggaaacttttaaaattttaaatgagaatgaacaggagaggggaacacatattcaaaattccacgtggggataaaacattagaagctgtagggagggcaaatagggaaggtaggttaggtctgagatccatttttgagaaactaaacttggaaaatttccataggttgtttactctttgactttgagatgtggttccattgcagtttcttaatcatgagctaacagaactcagtgtccataaaatggtagcatttagagcagtgttttgggtgatcatggccttactgttacgatagcggttgttaagtactttctctgcatcaagttcagtgctgagcactttgtatgatctcttttaatgctcttaacagccatgggagggcactagtattattagttttactaaacacatttgggaaactgaggccatcctttaaggatttggtcgtggccaaagttaggtttttatctgcagcttttgaatctccaagtagttgacacaggggtcctcaccactgttttttcttattgtttagtcagtgctaacctcccctccacattggacttcagacgtggagagaaattctcctgctatttgagcatgtaatataatacttgcttcaattgaaacaaattgacgacattactcaaaggcaaattgaaaagccagatctatgctaaatcccaagggtaagttagttggcatgtgcagtgatatatgggaaggtgcttttctgggttaagataaaaagtcctggtatcacgtcacactatcaggcaccccatctcaaactccctgtgccagccctgcaacttgaaatactcagtggacagaaatgatactttatagaaattaggtggtcatcattgttatcagatgaatatgatgccatcagcatgattttagcatcctcaaaaaaaagagatttacctggagggacacaagagaaaatctgaagcatggattgcaggattgtggcttttctgccggcctgccgtgggcaagtcggctgggagatgacctagtaattaaaatcctgcttaaacgtatgctgctggtcagttataacagaagcactaacatgggcaaccagagaaagataagaaaagcgaaacacaaaagtaacactcttgagcccacagggtgcagaaatagatctgaatggactgagtgcatatctgaacgctaagcatgaaagcagaacccaagtactaatatatttttatcccaatctgtgaaattaatcaatattttatatgcgaacatatgctcctgtgttgctggcttatttaattgacagttgcaatcagcaggataccagttgttcaaacccacatttttcatccacagttctggggagaaatgcagcaggggacccagggaacagggacacagacagtgtcagatttgaggcctcttctcaacccttcagtttctttcatcgtccttggggcaaagtaataaaaatttcaagatagtgcaaatgttgaatatgaacagagagcaatgtacttgggctactatttagaagaatgataattaaaatgaacgtagttggtacaaattgagatctttaattcttcattgttttttatctgtttctcttttgaacatagctggagaagccaacagatactgagcacctactatgtgctgggcctgaggcaaatgctgttgggtgtattatccgtgggctggtgggtgagggggatatatcccagccagttccaatgtattggatcatttcttgatagaggaagaaaatatatctttggtctttctttgccaaaatcttctggcggaatcatcaaaccagctgtgcttttccagtaactattatgtgcaacaaatctataaagtcaaacctcatattcctctacctttcaactttggcagaatcctagaaactctccttgatttggttagctaaaggcctgtggaatccaatctttgctgtttaaaagaaaaagagagttgggggaaagtgttattaaggtactattttagaatagtctatttgttagtaaattgttattattttcatgatacgtgcaacattctatagtgaagaccattggaatggacaatgtccagattaaaaatgaaagttaaaaggaactgcctgatactttaaaaatgtttctcatagtgttgctatcgtttgtgttagatgttcagactcagtgtgtgtttagcagcccaacatgtaacaacagaaaagcttctaagcctggaagtttggcagtattttcaatgttcctgtatttaaattggcacctgtgctattatattaggatgccattttctgaacttggaaatagaagaaggtggagagagattttactgtaattcatatgtgggtctgagtcttagggggaaaataactttacttggaaatagagtagtaatattctgtaaagttaataaatatccaccctctatcttggggataagaaattgcacaacttaagattttatgggactttggctgtatttgtatgattgaagtgaatattttagccaaactgaacagaaatttcagataaacaccaaagttgaagcgtagtttgggtgttttaaacatttgactatatcaatcaacatggattctcaaagtctcaagtccagttgaatccctgagattcagctatgtcatttgtaaagtggaatgaggaacatggtctgtttgcctactgctcaaggttgatataaagaataattaagataatgtatggtaaaaccctttaaaaacttaacaatgctagttaattgtcaggtatgggttgagtgcagagtactgtctacccagtttgtaaatgaatgaggtccctgtctgcaagggatgcgttgactagttggggtgatttgcctatgtatatacatgcccagctataaacacatgcatatatcaagatgagttcaaggaaaagtgcagtaaataataaatgggaaagataggaagagttcactaaagggttagtgttttgtagactgggatagaaagagacaccttcatgcaaaagatggatctttttggcaagtaactgtttgggtgatggaagtaagtggtatatctttcataaaaaaatatgctgggaacatgcaaaggatgtttggagacagtggatttgggaagctggtcattaccatctttcttttcttcttccctattttccttctccttctcctacagcaacttctcttcttcctcctcctcttcgtcatcatctcacaatttttgcccactctgtactgaactcttcacatagattaactcattcaaaccttacaacaatcctatgaggtgggctgtcttataattattgtcctcaattaaagtggtagaaactgaggatttcaaaaagtgaagtaatttgcccaagctggtaaatggtgaagctgaaatgtgggctagctgaggccccctgaatccagagctggtgctcttaactgctgctgaggctgaaaatgaggctagaaagggagaatgggccagactcatgagggtggacttgatcccgctggctaagttttgaaagctggtatttgaggaaggttaatctgggttttgataggtagactggactttgcatataactaataattatgtagtagaaatgaatcacaaacaggcaagtgcgagtatttgctctttgatgtccagacagaacagcccagaccccaaagagtaatttttgaggaagttgagtcagtacatcatagagttgagatgaaagtggacttcccattctttgcatggcttatgtgggcaaagtcaatgatacatattcctgtgcttatgacatcacagatcatcaccacggaaacatctgtgctgtaacaaacgctggattgcagtgtcactaaatgtgtcagggaggagaggaaactggctcaaaatgataaggctctgaataatgaaagttcactgaaatatgttagcaatggcagcctcggttgtggagagaaatataagcagaactattccgaaaagcacaaagcaggacttgtgcattattaaaggttgggcaaggttggtttcaaaatgctgctcacattcaaaacatggttttcttaaaaagtcactatctatgctgtcttgcatgacaataaaaatccttcaggaacaggagctcatctctcaaactgcgtatagaaaatcttctgcatagcaaagaaaggccaactgggggacttccgtgtgttttgggagaagacgtaaagatcaggagcagaattggccatgattatgtttattgtttggtaagtcagtgacagtattagttcaatgattgcagaaattaataatcagtaaaagatgactctgagccctctgaggatttatataagttgcacagtggtagatcatgaactgaatccagccttcagccatatttatgtttgggttgcatggcaccttcagaaattatgtattagttgctggcaattgaagatagagagattatatgaaaacctggatttactaatgtcttttataatcagaagagctggtagtgctggatccacattctcaaatggcaacgggtagggaaaactcagaaatcatcttccttttggatgaagcacatactctacatttagccacaatccccaccaatcccattgcatctcctcatcccatttcattgacttaccttcctgcctagccctgtgagcatttgattttgtgctcctcattggagggattggagattaatcgttgttcctagcacagttcctagtctatggagggcaccccctatattgtagctctgattagtctttatcagttataggctgagttatgaaaacttgatcctgagatcagcggtatccaattgaacttcctgtgatgatggaagtgtcctatctctgtgctgtccaatatgatagctactagccactataactattgactacttgaaatgtggctggtatgactgaggaaataatttgtatttcatattaattaattgaaaattaaatgtaaatagctgcgtgtagctagtggctactgtaatgggcaaagcaaaagcagattgagtaatgggatcaaacatccagtcagctgtcctcatttaggatagaatgtggaagatagacagtagggttgtgtgtgtgaacttgcccatcttacaagagatgacttataataggcttcatcacctaggggcatctacttccaaagtgggaaccactacctggctagaattgttgtcaatttcaggagcctaagacatgtgttttacaaaatgtttatgtgcacattcatagcaataagtgtaagtcatcttaagcttaaataggaagtctgactgttctctgtcccctaaatgttcagttaagggtactacttaagtataataactgtacttgtgagtggaaaagcctacattatttgatgagctgcttgactcccacattcacgacagcatagagccaagagccagggtgagtgagggtactgtgagaaggaagcctgtggaatcctgctagactgctggagggatcctctcttcttagggccaagggcacacaggctgccatctcttgagatttccatcgtgaacacactgagcacatctaatgatcatgttgctataaaccagctcacaagtaggattctaaaagatccctctctcatgcaactttttctttcgttcgcaccttgtttgcctgggaaacttgtcactggccctctccaccgtgcctggtagtcagagccctccatttgtctttgtcatagagttgaaacccagagccatctaccaagctctggcttaatggcaacccactggcctttttcctgaaacctgcctgccataagccaacttttccagttgatcaataaatgacttcactgcttctagggatatatacatggaggacaaaacagatgtctgcttttttcactccagtttaagctcaaattatagcttctgctcccacacccatacccctgccccagcaaaaaaaaacatgcctccttaaaacatagaaatcttaatgaaaatgatagaaacagtgttgtagctaattttgttaagtgatgactattaccgatcctcttgtaatagaaaaaaaaagaagaaaacacacgtgactatcttctgcttggatcattcatccaattggaattatacatcatctaatcttacagtcaaattctgctaagaggataccatatcttttttatctttgtgggcaaacatcaacgtaaactcctattacaatagtgaattgaatgattcctagaattcaataggaagagaaagacaaaaccctctaacaaaaaagtagattctacatgttttaaaatttcttcttagcaaaattcatagcaaaaacatttcctagaaaaagaccaaggtaatatgaactgagagtaactaatgaaatgctaaattatctgcacgcatctatgtttttattgctgaatttggtcctgcctccagacataaggaggctaaaaattcatattcagataaggaaaggcaaaccttggcgaacagatggagcagagttcagcataaaggtttaatcctatcaggccgattcctgtatggccatctggataatccggcacacacattcaaggcctgttaaaaatacgactccagccaagattagcgtcacagattttccactagacttgctcatatttggctttatgattttccaggcccaggaagactgcttgtgaataaagacttaaatagtccttgaagaagcagttgcatatttttttaacctgaaaattgtttccccttttcacaatattgggtgtccatttttggaaggttattttcatttccttttttccccttggctttcatttcccaaacttttcttacaacaggacaataaggagaattggactaaaaataattttgtgcataaaagttctccttgtcaggatgaagagagttatttacttattgtataatcagaggcacgtgaatgtactattgttgcaacaaatatcacaattggatccatgaataattcattttgaaaattctcttaccctccatgacaatttttccccattgctttgcaatggagtgactgacagtcatagaataagaggtgggaaagaaacccaaagaactgatgacaatatttgcctttggctgctctaggattaatattttgtacattttaattttggatttggcagatcaaacatgaggtggaaaacagtgtagtcacaccttgagttataaaattctgagctgcagtgtagttaacaaacaatttttgcatattatgaaacaatgctatgttgtgtgtcattaaatcaaaaagccttcaacaagtctttcaagtgcaatttagaagttacaggtacatcaaaatgtcaagatttcttactgctaaattgtcaaataaccccgtgtaatgaacctgcacacagttccagatctccgacagacaaactcaggaatccaaaagcgcttgccctggaatgttttggattacagttgttgcaccagcatttttgtccttcccttgctcaggtgctatgtccattgattgttgaaaaattttgctaattcagaataaaataagaaagctgcaaaataggaagagaatataatttgggcttagtctataattagcaaatggcataaattggaacttagacactattttgctaagtttaggtacatctagatattcaccactaagctaacactgccttaatgtagatggacattggagctacatttccaaatagtgcctgtgaatttttccttttcttcttttctgcgagagccattaatgctgtcaaagcaaagggcattcttgccaaatgaagtcactttggaataaaggatgaaaatcacttgaaattctcaatctcctcatttaatatttaataggtttaattgcatctagtatggagagatctctgtatcatgggttacatttctccttaaagtgacaaacatcacacacacacacacacacacacacacacacagacacacacacgactctttttcatatataatacatgaatctttgccaagtattatctagatatgctagtggacaggacaataaatgcagacaaataacaaaatgaaataaaaaccctaataaacaataaaatgcttaactgcataatgcaattactgaagaaaataaagtaaggcagaaacaaatccctagtaacacaagttaaagcaacagcataagtgttataaaggctgctacaccttgcatgaggaaactgtcaaatttgtttgtttgtttattggctgagtttatttgtttatttggagttagcattctgaaagtgaagtttgcatactctggtaccatggttcaggtcaggcattctaattgcttctggtttctaaagcatccagttggagaatggataaacaaagaatagatttgcctcctgtgcatggtgaaaatacagaggtccagtcttccagctggaagaaaaccttctgtttgtcctcttgcctgtccagtagctgctagtttcaggatcaaagaaggcaggttgtagtgctaaggagctgtgagcaggaaggtcatcattcactgaaaaaaaaaaaaaaaacaccagcaaaaacaagcattcagatcgagcaggaggaagagatatctgtgcgctgagtccaagtggaatattttgtgccctcaatagtctctccgtttctcccaagtacaacatcaccaaaattaaggagataaaagggagaaaagcatgagttttacgaggtcacaagtatcccgtagaaatgagctgagctcatgggttttatgttttctgccaagtctcaaaaatttgggacaataacattaaagtcgattcctcatttctgaaaagtttcccattaatattcattccaggcaaatgagatccttaaaaaaacattctactttggagggactgttgccagttccacctactcagtacatttagttggatatgttagcaagcagctgaactgggagttcttaggaaagtcttacaataaaatacataatctgaactgatgagagtatagggtattctcgtaaataaactctagttaatggggagctgatggtaattattatagcagcaactagcatactatgtggtgcatagtaaagcaacaaaacacaagtaggcattttctgtgtattttgctggaactctgtgaggtgagtgcccttatggaaactacaacttaaagaaggtaagagactgtttcaaggttgcactaggtgctagatgtggaatttgaacaactggagctcttgcccattttcaaatacagtcatactccaaatgttaaaatcaacttaacataatttcatatttctgtctttactcagaagccagtaaaggctagtgccagtattttcacctccactgtaagcatcagtggtctgctttgtagaaatgctcactaatagagagttctggttaatagaattctggaaaaggagagtgtgcacgttttcctacaccatatgtaatgggaatggaaaagaaccttatatcaccttgagatttagatttagatttagattagaaaatttctaaatttgtacattttatcaactcacagagtgttgtttctccagtgtatttagatacaggaatggagaaaaaagccaaacaatatatctctaattaggctttcataatgtcacatcgattgtcacaaatgcctcattttggggataagatatgataaatgctgaacctgggtcatctatatggctaccccaaacaagtgaggtattgatcacagcacagagagatttcagaaggaaaaataagagcagccctagggccctgctgatagctgcacacaccactaattcacctcaatgggcaggcacctctgagctcaattaacccttattcccaaggctacccataaaacccgaggtaaacatggctctcctggcccttgctttctatcaaagaaatagatcatttctattggaggctgaagtgcgattccagcttataaattcaccttgctaataaagagactgatgctcccagtgcgagtgtgcaggcacttgaatcatgtaacacttattctgtaaatcagaaaattttaaactaccgagggcatctctgatttcttctgccttctgtggctgttcgaaggaaatataaatgctcgggagatagagtaggtgatagcaaatgtcccctggtgcagttgtctgcacacagaacattagttgttaaatacgtactggagctgaacgatttctttctttcttttttttttttttttaattcttccctctcttttccttctcaccatgaccattgttcaagaagcaaattggaaatctggtaattaggccctgactcacggtgtagtattagagtcctgagccaaagttcaacaccctgaaatgaaatttaaaccaattaatctgttagatttttatcgcttgtccgtgttttctcagcaattcccccagcacgtggcctttgatcaactctcatacaaacgctaaaatgtgtgcctgctgctagcaagatgggaatgacattaacatggtactcataaaacaatcagagcagagaagccctcaaacaggcagggcatagtaatatttaataaaagcacacacataatcttcagaattagcattttgtgccttgcagtacctttgggagaagagcttttatttgtggagtgatcattattataacaaagaagagctacctaataatttccattttaactctgcaatgtgccatgagcatttcagagccattatgctaaactgtggtagggtaatcatgttattgtcatagtttgaaggaaggaaaatctcctctactttcgtggctggtgaggggtgggggaagggatttaaaaaaagaggcaaaccccaccccctaaccctaaacttttatttttaatgagatttaaaaccagaaattgggtcactggccttgcggatacttatgagtgtgaaaattcattggagaggaagaaagaatcttgtattaattaaatcaaaaatttgctggtaaaagtggttttgtattcaaacactgcccccacattccataatatttgcttggagatagacttgtattgattatcacatccctgtgctgaattgaactctttcataaatcttttcacagtcaaattccactgaatccatccactgtgactattaaaagtgatttttccctgtctcccctctgtttctctctgggtatcccaaatgtaagaaacaagtccttggctgctttgcatgttgtctgagctttctcagagaaaacatatccaaaatgaggagagaaggggaggctcagggtcagcgcagctgttttgtttgttttattttccttttttaaaatgtaattttgctctaaaaagtacaactgtttgctctcatagaattaaatgttctgctgctacttaattttttaaattattattacatagtaccttatttgtacacattgaaaaaatttaaatcatacaaatatatagggaataaatgttaatagtcctccttttctgtcaaccccagtctagttctttttataaggacctgctggggacagttatgcatatccttccttccaggcctttgtccatcatacttgttcacatataactgcatgcatactcatactggttcatatacaggttcatatatatcatttaaaaatcaacttaattacactgtcctttagtttgcaaattgtttttttcacctgctaacctattttgaaatctttccatatcagtttatagaattgttttgtgtattttaatgacactcctagtattctatcgtgtgaatataccataatttctttaaccaccccctactgggagcacctagacatctgaattttttgctgtcaataccgcaatgaacatttgggtacctatagttttagccacaattgcaagtatttccaggtcttcttttagcctggcagttgtgttgtgagtagggttaaaatgtaaaatagcagcctgtgagttaaagccagcccacaaacattttgtttggcctacgcattaaaaaaatactgaattcgtttccaacattgaaagattgaaaaatttgacataaaaatgtggcttcctggcttctttggaaagatcaccagaaacccagacgatgctaggcctgcatttttatggggtcaccaaaggctgaagctgagcagtgctgtcacctttccctggggcacgtgcaattcaccagcaccttcccgttgcattacagatgttgagaaacagtggccattaatctcatgcttgttctgagagcctgagctgctgcattcgtttgtatgtcttgccttggtctacatgggtctgtgaattcttaacaatagctcttgggcctgattctcttttgctggtcacagggttttctacattgcattattgacatgttggggttcttcatttatggggactatcccatgcattcatgcattgttggatacttagcattctttaatttaatttaattaattaatttatttatttattttaagagacagagtctcactctgtctggagtacagtggtgcagtcatagctcactgcagccttgaactcctgggctcaagcaatccttctgcctcagcctccccagtagctagtatgacaggcttgcacctggctagtttttaaaaaacctttcaagagacagagtcttactgtgttgcctgggccagtcttgaactcttgaccacaagagatcctttcaccttggcttcccaaagtgctgggtttacaggtgtgagccactatacccagtttgacctccagttactaaatactactagcttcccctcctcatcctctctctctgggatagctcatgattcctttacatatttttgaaatttgtcagtggggaggtgtcacagagcttcccctcaagactaatatgttataacagatgtataggaggagctttggaacccttagaggtctaaacttagaaaggtctgaatgacttacctgctctaagaatggcatatagtctcgaagcagggatggtggatggtgctgagtgtagaggtaggagggactgaggggtgtgtcattcttcctggggtacttcctttaaggctttatttctctaaaactaagacaatggtgtcaaatattgtttcctcacctggttatctctggaagcttgatgctctttcttgcctctgaggcattgacatatagctttgcttctggaaaattgctcacagtatttgaaaacattgcaactttccttgggaagtgtttgaaagcacatacacacgcatgcatgtacacccacgtgacttctgtatcctacgtataacaagtgggaaaaaagagggaaggggtcaagttcaaaaccagcaggtcttggccatgctattttaaggcctttcctgtaggagggtttctcaaagacacagaaacacccccttccacctccctttgtgcaatgatgagaaagcctgcaggagaccgtatttagctaaagaaatatgtgtgtgtgattaaaaaaataaaaattaacagaaattccaaagctaaaactgataataaacacaaagaccattttgtgatctgtgtgggtaatctcagggtcagcaattaatgaccccattggattccacagtttgactcagtcaggactctcaagaccaattcagttaaaccaataacctgttcttctcagaagtactagggatatcataacaccttttgtactccattctagcaactaagtagactgagttataaattaagaattgatatttggggacattaacaaaatgtttccaaactgcatatatttttagaactttatgtagttgttaaatatagtttatttctcttataacttgcttcaaatcatacatcatatggtaccactggtttgggagtacttaatcatgcatttaaacattttttacttttaaaggtcacttttgtttaagaaaaagccctatagttgtggaacactgatcacaacctctatgtatgttaaaaaatcagacaagaaatgtcaagtcacgaatcatttacatcttcttgattaattattttgtttttgggagaaagtagagaagagaaaagtcatctgaactgcccagttttagttgtaaatgcattgctatgagttcagccaacatgaaatgtttagtttggatatttccaaatttctctgtgcaaatttttaagattaatttgaatcaaaatcaaacccattctatttgtttgtgtggtggcacgtgagcaatggtcccaccgggctggacttaatattttctttccttcttgcaaaagttaaagcatgacattttgccaaatttgacaaagtccaaatatttttttgccagttttttcccgttaaaattaactagtgctctcattggcttcaatgctcagaaagtcagtcttggatacttaataaactttttattaaagatgagggtcccattttctctccttgaacaatatctccctttaggatgttgctttcttgttgttcataaaaataatcatgagaacagaagcatgacactgtagagttaaaaaccctcagtggcacgaaggtgcaccctgagagattttaaaaacaatccaagaattacatttatgcccagcaattctgttgaaagtatgccatgctcattaaacaaaccacctccagtctatttggaatcacagtatttgcaaattatttcccatctccaagggccatttataatggaaagaaaagagatatgaaattttgaaaaagtcaattctagggttttatgcctgggaaagacagcaaagcaaaggtcatggaaaactctgtggttgagccctgactcagctatttggttacataattcaccccgagtgacctgcattcttcacatctgtaaaatgggatctatgacatttatttgaaaaaaaatcgtaatgatttttaatgagacatgttgcaatgttagtgtttcagacagaaggcatggagcaagaatcatttcccgctccaggctcctctctttcttagtttcctattggatggtaatgtttatctaaaaaaacgtaagttttcttttcaggagatatatttaactatgaagcaattctgtaaggtttccaatatattccagaaagtcacccatatttaataagaaaaaaatccttagcatttcacaaattaaaatttgctttgtgttttatttcataaagtttcaggtttgataaagatttgggtaaaatatatgtatcttaatagaaacaatgaaaagaatgcttttaaaaactgaagttgcaccctgaagtttcaggtcctaatgtggctgggaaatgctgagatcttgagggactttctgttagtgaaaagataaaagattttttttttcctttttctcaagtcttcatcattaaagtttggttctaacagcagactccttctctttttcatgtgtgttgaaaagcagctactccctgtatcaaagccatcagcccgagtgaaggatggacgacgggaggtgcgactgtgatcatcataggggacaatttctttgatgggttacaggtcatattcggtaccatgctggtctggagtgaggtaggtgttgtctgaacattaatatctaatagcttgatctagttgaagatactgtctatacttgaatttctaatagaatgtgtagactctagtggtgccgctctgggtgggccagcttcagtctacagaatttggggaaactagaagagttggtttgggtttaccaggaggcaacagttactactggaatgacttcctttctttggcccataagcaatgggagagcttctgttttgcagtttgtcttcttgggcttgccatggtgtggaggtcctattgtatgttgggaattgaagaggagatgcaaagtcacaagatgtatagaaaaagcccattcaagttttagcaagggtgtaatctgtgactattttgcagaaagagtctacggtagcctgatcttcaaggaacatcattcaatggcagcataatccaggtgtaggtggttcttgacttatttggtgactattcatcagacagagtgatttgctgggagaacctagaaccacaaagggctttttctagctctaggaatttacagctctcaagcatctcagtgtgtgactgcaaccccatgaaaatgactatgttctaattgtgcagtactgtccaagcactgtgattgttcttttaacctaccagttgacttgtctggcaaccatcagcatcagctcaagattacaaaacatgcatcccgttatatagatgccgtggcaaatctgccattgtgttctcagttctgagccccagtttcttagccagcatgctccgagcactctctctttcacttcactaaagtttagaataaaaacaatgttagggttacaaggtaccatagggttcattcaccccatttgctttgtaagcatgtagtcatcctaacttactgagacttaccatatgctaggcaatgtgctaaaccttgaggtagatcatctcacccttctttctacactacgaggtagatactcgtagcatatttcttttcttgataaggatagtgaagctccaagacaaatagttacatagccagagagcagctgcccaaagcctatagaatgtaagtgatttgtatatggccacacaaagatttccatttctagctgtgctcccgtgacactggtttagcctatttctttgtgttgttttctctctagaggggccatgcagatgagcagaaagttaagactgtgatacttgggtatgtttgtctttccagaacagacgctgttctttgtaagccttctgtgtatactgcttactgccagtaacccactcaggcaggccccttgctagcttgtgctgctgctgccttggtattttctactcagcaaacaaggggtatgcatttggtcgtagaatcaaagttctcataaagccaaatcagagatgagcttcccagcccactcaactaatttttaggcaagatggaacatttcaggtatgaaaggtggagtaacttccccttgccaactgtactctatgttttgttgaaactattgggttgtaaattagaagcatcaaattcatggcatgttttgctgccagcctgctgtcttcctcctgctggagacagcagtcctcatgaggacagactgtcccaggtcttgtgggctgtatcttctaccttttccatctttctttctgttgcttatcaaggaagttgagagatgggaagagtaaatataatacggactccttgtttcatgtcattgtagtcaaagtggagctcaaaattggcattaaaaattactgaccctttgagaaggaggtgggttagtctgaagcttcctgtaaaaccttgtgccttcttaacccaagtggactccattgaatatggaataaggacacatcaggaaatcatgcatttgcacctctgccttacgcttaatcaaggtccctccattttttctcactttcctactttcttgacctgttttgggaacagcaaagggaggttagcatgtaacttggatttatccaaattgctttaaaggatctgtttctatataacaaaattgatgaaagtcataggaaggaaaacccattaatgtaatatctttgtcctcctccctcctctgtccctccagtgccactgccttgtgtgtgccaggagcccctcttcactctgtcccaggggtcagggtgggtccagccaggagctgagggtggaggatgcatgctccttcattgtccagcccctgctttcgtgctgctcttggttgtagctatgtcataaatcaactatgaccctgtcctggtgcaaactgtttcccaaaatatttgtgcagatcttcttttaaaacaagcaaatccaactgcattagcagttgggtacctggatgtaggactttaaattgggctgttatcatcatgattgtcctgatgttcagaagaatgatccttgtagaagtgaacccttttttgtaatattctaaactatttctatatttaggttttcgtacaggctacttggcacacacaattttctctgccttttcatgcagggagagaatttgatactgccccaaataaagaaatccattgtataatggtgggaatggagaaatagctcagacttgctaagggttcatcatgtgtaggcactttatgggtattactttaagcctcacaataggcttgtatgcaatactcctgttattctaattttacatatgagtaaactgagtttcagagaggttaaaaagcttgcccaaggttacacagccagataggactagagactggatttgaactataccatattttttttataaaggaaggaaaagtcctagttaataagagagcacatgcaatcttgagagagggaagaatgacagaaagaggaaagaaagaaaaaaaacgaggtttcataagccaggtggtatagtagtagaaagtagtaatagtaattgtagtagtgatgatggttgtttttaatcgaataaaattacatgagtgccttttatttttgtagaagcagaaaaatattaaccaagtttgaggccatttgtcaaggcttgcattgtacagaatcagaatttgatcagaagacatctaagaaaaagctacagaaaatgcagagtgtgactaatattagctaacattcattcactgagcacttagttcctgccaggcaatatgataaatgtttggtagtgctcttgtgggattctcaccactgcgtatgatgttgttctcattttactgatgaggaaattgaagcttggggaagttaaataagtaagtggttcagttgccaagtggtagagagatgggacttgaacccaaacagtccaaccccagggcttaccttcttaactttcataatttagcctgtgccaccatttttatcatagggtgttatcagatcagggtgataggctcacattgccatgatgtcttgtgctgggggtgccttaacagttgctgttaccttccaaggtcaggtagaattggcatgtacagactcagagaggtaagagggcttcccttcatcttccagttgtatatgtttgtgatcggcaccactggattctaggtagaatttatctttatgaagtaaaggatacatgcctacgctagggcaagacagttcacctgtttagcctcatctctagagctggatccctgtccatccaaagtctttgccccagaccacatgatcttgaggtttgtgccatgtctaagatccaggccttctaattttaagtagacttttatcacttctgcatttccttactctatacccaacacacccaggaagcaggctggcaggctaggacaagtggataacattttagattagcagctaatgccattatttagagtctttttttagctaaagaattttttaaagagccagagaaaatcaggctggcttaacagactctaatctgtgctctttccctaccaatccaatcttctgccaatgagtagttcagtttagctcatggatcaccccctgaggggtgggaagaagaaaggggcactttattgctcctaactcagctctgccttctgcgagctcccaagttcacatggcgttcttgtgaatttgatttgcccccttcctctttctttattgtttcttgcgatttctcctctccctctttttagaaagtaaattattttactcttattcttgtgctccttgccctgtcctactctaaaagtcttttaaaaaattgttttagtattttatatacaaatctaggaaaactagcagggttgatgtgtgatgtttaatgtggggtgagattatttttcttgaccagagccgcacttggttgttttgcttttctaccaacatgtgatttggagcagggaggggctcctgcttctggtgtgcagaactaattgttagtttaatatctcctctgaattcctccaatttctaaagagtgagcactggttggcttgcctgctgggtgtctagcactgggataggtaccatgggtaattaaagttgggctttgtgggatctggtgttttatttggaaagacaacttgcttccatgcagcaaattagagagttacataatatatttatataatctagtattaaattggtagtttacaattcacgctaagttctggaaagcagagagagtggtgtagtcagaagtagatggtttgaatgaccaatcaagttcctcttacatatggatgtagctctgtgttaggtatgttaggctctcatgacccttttattttatcacagaatttatacaatttagagtatttaagctgtcaattaaaaaaaaaagtacaatggtgggtttcgtggggagcagagaataatattccaggctgcaagggttgagattgcatggggtagcagtggataaggaaccaattgagagacttgggtattgattgtccttccattgcccaatcagaggatatagatttagtcattgttggtcgctggacctcagtttctcatctgaaaatgaaagacttagtctatatcctctttgaaatcagtgctacaattctagcaattcctttttttttttttttttttgagatggaatcttgctctgttgctcaggctggagtgcagtggcatggtctcagcccactgcaacctccacttcccaggttcaagcgattctcctgcctcagcctcccaagtagctgggactacaggtgcgtgccaccacacccagctaatctttgtatttttagtagagacggggttttgccgtgttggccaggctggtctcaaactcctgacatcgtgatctgcccgcctcagcctcccgaagtgcttggattacaggcatgagtgactgcacccagcctagtgattccttttagagtttattcccctgagaatcctcccacagtcagaaggggacagtggtggcaggtggaaactgctccttttcttccactattgttcttttctttcagagcacacttgcaatacacagatgtgatgttgatttgcaaaagaattatttaaacttcatcaaaacaatttaattggccacaaaactgcatctccctattgataggtctttagtcaatatttttactctctatgcttcagattctggtatctgatataaatctgagacttacgccacagtgttggcctaattcgtcttctagataatgttatggaagactagttcttcaggatattaatagatacccattgggagatgagagagggaggtttttcctggtaagtttgggaaatgctgagtcaaattctgctggtctttcttctagggctttgcacaacgtttgaggtactagcatgcaccgcaaatacttagatgcagtattcagcatgtcccaaacttttgtgaaggcagaactcttttttttttccccaaggatcaccttacagggagatatattggtgatggctgaagtgcattttgatttcatgttaatggagccaagtcatgaaattcaatcacaaagtggttggactgggatagatgtgagaaaaccatcttaaatatttgcagaatatcattcagattagaccaggaatgtttagagccattattctccaatgctgcaaggctttgaacaaaatttccctcatattttgcatctggttttagtcagtacacacttggcattagatgctatatgattttgtagggcagctatatttaaagattgccagtaccacttagctcagatggatgaagccaaagtttcctcgtgtgtgaagcaattagtctcacacaggttctcctcgttgtctttatccagatgcatgctttcttcagctacattcccagacacggggcatgaagtcaaaagaaacctctgggggagacctgtgagtgaatatagttgggtaaatggtggtttaggggctcagaagcaattttgccacttaaatcaaaaaattggaaaaccaagtggtaaatgcagtccttcatttctttctttcttcctatctatctctactttccattctcctttgtacacatagctcagaggaatgattgtcaataaacaagaggattggcttccctatgatattcaagagtggttgactaagatgcatacaggtattccaccggaagtttcccaggcctttttgcccggccttgactcttactgaaccacatgtagagtcaccacattttaagggccttgagaaaccttttttcagtcaagtatagtttcttattttgtgaggaaaaagagacttcacagtggtagggtggcttgtcctgggagcatattatctacttaatgctgggctcagagcccagttctcttgacatccagcttcacccccattcagcttttggttataccagattttctcatgaaatttccatgggcttttaacatacttccagaaatttaccaaaccttcctaaattttatacataattgccctaacactctgaagacttatctataccaccttttatgtgagatacagctccactaaaataaaaaagaaaattaagacggagaaagacattatgtcaaatattacctctttcaaaatgtcatgatagaaatgtaatacaatgtaaatagttgtgtccatttattttacatatattgaggcttacatgtataaatttaattcaaagttgattaaatgtgtggatttaaaataactcctagttgcctatttttttctaaatatgtttcatgtcctatatttaacctgtgcttattgaccatctattatatagaagttgctttgtgcaaaattataaactttatttgttaacaaatttaaaagcagtctggattagttgcattaaactttgaatatgactttgaagaacaactttcaagcccaagtaattttatgagaaatcatttctaaatgagccagcatattaaaaaaaaaacagataaaaatggtctaatggcctttttaatatagttacatagttacagccatgctcactttattcctaagaagccttagtctatattgttatttttgatgactgaggcacttgaaatctattttctatgttgataattatgaaatagttaaaaaaagactttaagatgacattttcagctcattatttacagcgtgttcaggaggtacacgtgtctgtaacttgaaaataggaaccacagaagtgtgatgaatttctaattttcatatgaatcaatgacagaattcacacctggctgcagtcatgtgacttttatgaagaaaatgaatatttatggatatctagatagtgctgtattcctttcttgctgattgctgatcactaggttggctccctgataccctgaactaaataaagccttctaccttatacaacctttactggctttctcttttctaaagccacaacttctttgggattcaagcacaccaccttgactccaacctttcttttcaacatcctcaaccaacattcattttaatttatgttctattccattgacttgttagctgctccttgtacctgcagtaacttttctccctgtcttgctggtgccattgctctccatgggatccttttccctcctttctgtgcccatatccctctgccctttaagatcctgtaaaataccacctttttctctggaatcttcccatatgactccaggtatagaatattttctcttctgtctaaattcttatgttgccttatttctaccatactgtgttccttatacctttccatctttaattatcctgatttaagggcattccctcttccttgaatgcaggatccaggataaatacagcttaattttctgtgatgcccagcacagagctttgcacttctgaggcattagtgaaaatttgttgaatgacactatttcccctttcattcattcattcattcagtcaaacaaatgctccctaatagcaactgttgtagttgacaatgcttgaaagtgtcagtactagacagattgtggtccaggttttgctaatgcatgtatgggtaggtagtttatatttagatataattgttgtgtaataagtatgcacataaatgtcttaatgtaaatctattggtgatggtgaagattgagtagtaatagaagtaacacgtgttgactgattgatacaagtgatgccttttcctacacttgttacaggaattgtgtcaattaatccttgtaataaactatcagataacaagtcccatcctactctctccccctttccccaataaggaaactgaaggtcacagaggttgagtgactttccaaaggtcccacagctgattattgacaaggcttggatttgaatcaaagtccacctgactccatagctatctcttaactatctaatatgaatgtaataaaattcatttatccagagatgtgttataataatctcaactccctaaaattcagcatgaaaccagaagcaagccaaaaaagtaaataaaataaaaagctttgggttaatgagaacaatacttcttaacaaactatgttatctgttttcctaggtcacagcaaattaggaggcccaaactagaggaagatcatgtgtggaggcaggctattggatacaggctcagtgacagctgatggcctgatgtctagggaagaaatggaaagccgaaaaagcaaacacagaactatattactgtgcagctcattaatgacagtggccctgagtaatcaaaaaagagctggcaattatatttagtatattctatttaaaacagcaggatatatataaggcaaccttgaaagactttcagcagaagcagttgtacagccacattattaaaaggggtttggcttcagttttttgtagtgcttacttttattacatctctgagttcctgaatgaacacgttaagtgaggaattactggttgcatgtgctagtatcaatgtatatcatatctagatatgacaaacaccacaaaaaatgttagagtgagtctctgtatcgtaaagctttgacatctttttttgtttgtttttaagcttggagagactctacaagtcttttggtgaaaggtgaatttattccctgactactttatcagtcttttggcttttatatttttctttactaattccataggcaaagattctgccatgtgaattgccaatgttgataacaagcattcatccccttccataaatgcattctgatttccttttccttttatattttaattttcaaacaaacaagcaaggaacataggacactgagccaggcctgagtagggaatgatgttccttcttgactgaatttagaaaaacaagccttgagaaagagctcattgtgcagcctcaaaccacaggggctggcgttgctggtgtctgatgctctccttctggaataccctgggcctcaggaactcacccttgcttttccagctcccagatggtcaggatgggatccagtctttaatggggcccaactggcacaagatctacatcctgggaagagagctggagaaagtttatttaaaaaataaattacaaaataaataaataaataacccacaaaaccagaggtagtggaagcataatgtatttacttcagtcttttttctcccaaatctgttattttgaaagatgatcttgttgccattttgttttgtacaattaactgcattgatttcgggacctggttagatgcctggtcagaactgggcagtatatttctgtgaatgcttaatgaggataccaggaagtttgtggtggaaagtaaaaagttttttttttgttgttgtttgtttgggaattttttagtaaaaagaattctgaatggagtggtgttgattatttcctttttgtagattcataagaaactttagtgaatctttatcttaattattagtggtggctaatggcatcacgatatttattcattcaatgttcaagtatttattgagtgactactagttccagggccttgttaaacactggaaacatagcaaaaacaaagaaggccaaggtcatatccttatggggctgatattctacttagggggacacggacaatgaataggaaagcatatctacatctctctaccatccatctgagtctatgtcgatatctatattgagagaaatttcagtgttaagtaacatgactgactattcaaaagctagattttaagtcccccatttaactcaattcctgagactttaatttcaaaagtctcctttgacattcatacataaagtttatctttaaggattcatgtgactcagcatattttggtaaacatcggtttaaagttattttcttgaaaggacaaaaggaaaccagaatttttgtgaaacagtaaatgcctcctctggctttttctcacgttctctgagaaatcatacactgcttttgagacaggcaattcttgggaatgaaagaatctgtgttatgaaacccagagaactctgattagggaacaaaccaaaacacaccaaggaactcagaagaagagctggcatcccctgatttatgtggtagccacttcagggaaatagagatataatatggaggttcagccagcacagtcgccaagaatatatacttttcatatttcagcttcctttagcaaccctgaaaataatatattttaaatgccgtgtctaactccaaaaagatgcatgtttcagagtagtggagggaaaacaagtttgcctgtttgttccctaacaccttggtatctctttaaaaatccgtagtttgatttggttctagagctttaattatgcttttatgttacagttttcttatttaagtgtctgcttcatgtctatcactcagtaccccctgcctatctcaaaagagatggatattattatcctaactgaggagaagggagaatgctgtgagaattattaatacataaattaaaaaattaatctggaaagtgctttagggtccccagagaagctctacccaaacataaagcatgtataatattattatcagcacctccacagagcacataggagctggtgcagtataagattagtaaactgaggcacagagggtgtcaatgagtgaatgggctagcatgccttagaacgcagacccttcaatgggtaacatctaaaaaccaccttgccagtgcccactttaggctttttctagccacaaatgctcattatttttccagagaagaaacatttccttccttttatcccttctctttgagtctttgcttgttttggactttttttctttacttttaagtgttgaaggtgattaaggttaaaatattaggtcctaaacctagtaatgagaaatcgctggtgtgctttctagtaaccccagttattttttggctttgtggcttgcaacttcaacttgcatttattttacctactcctattggttggaaaacatggataaaggcttatcttggaattgcttttttgttttccttgggaatcattctcagcttgcctttcaccagtgaggaaagttgttttgagtggccactatgttcccagttcatttcaaggtatgggaaaagctgcagatacaatccatgctttcaaaggcagaggtcagatgcaaagtacatgtaccaggaattatggaaaaacaatgaacagtcatatgaacagatagtcatggttgtataatgatggtcattagtcaggccgactggccacttccagttggtttcttgatcatatttcttaactttcctgaaacttatttttctcatctatgaaccagctaataatcatacctaccccataatactacaggatgtaaatcactgaaagagtttaacatagcgcttgacatatgggaaaaagacaacaaaaggtcattatagttgaagtcgttatcaaggtcattaccatcatcaatttagtgagaactagaacaatatagataataaaagctgcggaattctacaacatgcttccactcatatttttaaacactagatactctcatttacctaccatgtgggccatacttttgatatgatgggaggctgtctaatacgcatgtagaagattgtcctcttccctgcctctcttctgggcttccagactttgcaggctgcctctttggagttctacgtgcacagctgcatgaactaccatgcattctctctcctgatttcagctcttctgtcaaggagaggccccattcaaccaccttcatgtctggctccatcttgtcatggccacagtggctttactttgtacccagaggccacagtgggcatatctcgcctggctaacccccacaggattcttcaggttctgtggtctgagtctggagaagagaaaatgctcacacaggcagcttagagggagcagaagtgttgctgccggcaggtccctggcatgctgacagcctcacctggaggcctgcagagattatgtgtgtttcatcttactgccacatagaaaaattatttcttatgaatatagtattaatgcatttttattgttgagcagttggagaattcagagaagcatacagaagaaagtaaaattacccatacctctaccatctagaggtaacttccattaacattttgaagtttttcctttcttctgtgcaaatacgcatctaattcttatataatcacatgtaatacatattgccccaaactgatgttattctactttttaaataacatttttctcataataaaaataatggctttatatgtacaaataggtttattccataattatttacatgatccagtgcaagtttgggacatttacacacacagaaatacatacacataggaggaagaggcagacagagaagacaaatcacactgaatgttatcagtccagaaataaacactcttaccatttagcaaagatcttgtgtggcatactttttaagtattaatttttaaaccttttttttttcatttcatcttatcatttctcactggagttacagacatttagacatccttttcttttttaccacttacatgatatacaagcagtggtctcaagctcatattgagatctgagtgtcgagctagtcagataactaacattaaaagcaacttaggtagaaaacaagagttgagtattatcaggttaagaacagtagactcacctggactcatggataatgattatgatacccagtggagtcaatgatttagtagaattctggcctaatttatgtaaatatttattccagaaatattttgaaaatatcttgtatgtaagtcattaactacttaatttgttttttattttattttattttattattttttctgagacagtcttgctctgttgcccaggctggacagcagtggcacaatcacgacttactgcaacctcgacttcctgggctcaagcaatcctcccacttcagcctcccaagtagctgggactacaggcgcatgctgccatgcctggctaattaaaattttttttttgtagagacagggtcttactttgtttctcaggctggtctcaaattcctgggctcaagtgatccttctgcctcagcgtcccaaactgttgagattacagatgtgagccaccacaccaggccaagttaactactttagaggttgcaaatgtgaattagactgtgttcctgatctcaggaaatatctaatgagagaaagatgtataggacactatttatggcacaaagcaaaataggctgctaagtattatagtatcaatatcataacagtataaattcctcaaaaatgcaggcaactttcacccttaggatcaggtaaaacttactggaagagggaacgtatgattggggtcttcaagaacaagtagaatgtcagtagaagaatgtttaggaaagaatggcatggagaaagcaaaactgttgggcaagggaatggtgttttcgtgtatccacatgccctttactccaatatgtggtaaagcaaagtgggaagtgtgcctaggaagggaaactggccatcaggccttggcgaaccctaaatattattctgtcaaggagtttgaactatgtaataggcaaagggggcagctgagggtttggtttgaggcagggcataatatgatgagattgtatttgaagaagataattatggtggaaaaagtagaagtagagggagaccatttagaaggcaatttttcctactgttgtaatagtgtaagaaacagtgacagcctgaacaggagaaagagaagaagcagagaagagccagtggggcccagtttggggcagaatcaatatgactgaagaaaaataaaggaagaaaaagaaataatgataaactcaagttttctgttttgggtaattcaaaggctaacattcctttaactgagacaggagacacagaaacaagaaatatatttacaggtagtaagatgataaatttagcttgggtcatgttgagattgagatggcaagaagacttatttggggagattctgttactctgttgctaataaaatttgatgcttagccaaagagatcaagtctacaagtgtagatttggaaatcagtttagctgaggtggctgagctaatgagtgaaatcaagaagtgctaggcaaatagagaaaaaaaaagaagacaaaacttgtgatatttctacaactaacaagttgacagaaaagtggagcaaatgaagaaaaccaaaataatcaggaatcaatgaataagagaagatatctggaaaatacttctttataagtataagagattggttttcatccaagtgttttaaataatattaacttgcctgaccatcaacttttctcatctgaaatacataaaccacaaacatgattttaaaaaattagtgaacatgaaagtgctttggtaaaccatcagacactttgcaagtcttacgtcttatgattattgtctcataagaaaatggagtgttccaaggaagggaaagagtagtggcagatgctacagagtttcagaagaatatttatttctagcccaaattgtttggcttgtaatttaaggaagttaagtcaaagaatgaatctgttctctaatcacttagaacagtatttaccaaagtaatggggcatgggtccttggtagtacaggagacatttttagatttgacacagacatgaaatagaactgaatcacactgtgagaaagttagtctccttttggtttctcttttcatcactccttttgtttctcttttaatctttgttttattccataattatgatttttattaaagggataaagtctcagggcaaaaaagtctttaatatttaacactagctaatcacccttttcaataaattccttcaggttgtcaacaatatctagctataatttatattaacttcaagattaatatctacaataccttcttattttgcagttgatatcagttttccaattatggtagtgacataaagttttcttttaaaataagttttttaaataaaaagataatcactttttaaattattaagtatgtaattgtataggtggtatatagatatgacaaaactaagaaagtgatattccaatgatgaaagtttgaaaaatttagactagccctccctccttctgttgctttgagtggctgccttgggttcaaccaggctggaacaatgtgtgaaatttattttgtgatttgtgggtccggagttctacaccctagatctagaccctgtccctcctctagcatgttgggtcaattttcggagccaccagacatttctagatttttgtgtccttatctgtcaaaataagaagattagctttaaactatcactagcattccttccagcaataaattctacagttctttgagtgattagtaaataagcctgtgctttcaaattgatcaaagttagctaaaatgtttttcctccataagcatcaatatcatgtgtcaatgctagagattcttcccagactaatattcacagctaggaaaacatcaacaaatttattctctattatgattcagattctacctcatctgtgaaggattgttgtttagaaggaatctctgctttagttagggcaattaattaaaattgaaaatgaaattgtaaatgaaaatttgtttgcatttcctgagcctaatgctttatgctaaagcctcactctcagtctgtagttttattgcagtcatatctaatcaatttataaagcccgtgaattttgttcctcggtatagcaactcatacatattaagtccctatacttaaaaagaatcttcatccatctatttactaatatctttccatcttttaaaatttatttcccctgagaacaaggagagcaggtgaagtgttttctaactggctgaaagttcttatcagtattattgtgagttaatggtactctatatcccaagtacgtgttaaaattagaagcataccttctatttgaaatataacaacatggaacatcctttaccaccaaaagcatggcaaagctccaggcaataaatgaaaaatggagagagcataggtacagaaaacacacacacaaagtctttggatcagaaaaaaactgagtttgttactacctttaaaaagcttctatatgaacaatttttttctctatgattacaaaggaagtgtttgtcccgtgacttttttgaactgcatcagtgttgccttttgctctgacttgctatgacaagggtaaagttgcttatgcaacaacttaattttaagattctgttttctcacctgaaaaaaaaaaggataaaaatacagtcattgttctgaccaaattagtgtttgtatgtaaaatatccagcaatgtggtagatacctcctgggtactctacaagttttagttcccaacattgcagtaacagtgtctcaacaattaacatgctcttgatttggggaagatcatctttcactgcccttcagagcctctttcttcttattctctctacattattaaactcgatttcctgatttccatgctcacagattacaagagcaaattagaaggtgctaagaacaacaggaaaaaaaaagacaaagaagcggaataaaagagaaataatttcaaaatcttagaaacctggagccatttagtacagggataaatagttcttcatacctcaacagtcatttagggcttttttatattacaagatataatacagggtatttgtaattgctaagttaaaatggtttttatgcagatatgactttttcttgtttcaagaaggaacatttgatataaattacttgtgggctttagcaataacaactttctcaaattattttccctaggacttggtgttagaacagtttatccagtcagggacccattggccgcatccagcctctcatggtgttatctgtgattctctgggcaaaacactcaaactgggcctggtttgcacattgatataagagccctttctaagttatccccatgagaacagaacaagcatgttagtttaaactcatgtatactgtataaattatccactgtatgcagtggactcaataccacaaatattgagctaactgcatctgaaaggagtcaaagagtagacaattgcagaatcccatagaaagagaacatgtagaatccagcaccatcagaggtcaaccagtcaaataccagggctggatttttcaaagaaccagataatgccagttttatggccattaataacattttagttatgtaaacaaagataagagtaatacaaaataaattctgcttcatggtgtaatctgattgccaacagagttcagaaatgaactttctcattgtgcacgtggcattgcataatggaccagtgatcattccgcagcctccccagccttccctttccctttcccttttatggagagtccttagttctgctagatccataagctattccagggaggcagattctttgctttcccctgtaaagctctttgattgtgcctctggtagttaatacaccaaatggtcttcaggggtacttcatacgtgcactccgcagctaatcacagtgccttggcctgctgtttccctacctctgtgttttccacatgttgacaggctcagttcaaacaccaggcccatcagcttctggagagtcacggcaaagctcggctctgatttgggtgtctgcttcagagattttccaaaggatatcctgtagtagataaatcatttcattaggccaggttccctgttcaaaccaggaagcagagggcctgccatgtaggaaaacccagataatattgttatggctgtactcagagcatttgtaaatattgttgtcagtgtctttcacgcaggttccatcaagattggatttaaacatagacaggttaattatgtgttttaaagctttgtttatggagagctattaggaagactgtgaagttttaactattgcaatgacaatttttccccccaaatgtctcctccagttgatcactcctcatgccatccgtgtgcagacccctcctcggcacatccctggtgttgtggaagtcacactgtcctacaaatctaagcagttctgcaaaggaacaccaggcagattcatttacacaggtaagaaccacagcacatggtgagcacagaactgccgtggtcttgtggggtctttccccttatcttgtctgtataaaagcatgtattttattttaaaatctagttaaagcctgctttctttcttcattttaccatatgtatgaccaaacatggtgcttttattattgtattaagaattcttctaggtgtccatgttgaatggcgcgttctgttgaaataactggttggatacctaaagatgccacatgaaaaataagagaaggggaaagaggtgtagctagtcctgagtttctggatgttaagccaccttgttagggtttgttggctttatggagtaggtttgtgctttcatgaacagtacgtctttcctctagcctgttcacggcacttgtattacatacaattggtagttttcatatttaattctgggttggtgccttctttccaagtatgctgcatttttgtcctcccaaaacagccttggcacatggatccgccttgcggcaagaagctagggtttcagagtgaatgtgaattccctcccatcagacagagagaaccaggcagcatctctgtggaatgacatcaagtataaaggctgagtgcccaatgtgtacgctaagagatccctagattgtgaagtgcaaaccaaatacccagggatcttttacaattcacattctgctacagtaggtctaggtagaacctgagatcctgtttcttaagcaatcccaggtgaggctgatgctgctgctcaaagaaccacaggtggagtgcggttctgggccctctgcttagtgtcagtcatccttggatagtggtagctgtctccacgaactagtcccaggtttccttttccattcagtaaaagaccacaagaccagattaagtacagagcggaagttgctttcacacaaagagataacagagcagtgaagggataacagttaacaaattgtaattataaccatacaattaagtggacgaattttatttttctgtgacattttacttcagagcatctttcccttgtatttcaatattagaagtaaaaccaaacatacttcttagtcacccagtttctctctctctctctctctctcgaaattataaaaacaattaatgcatcctgacccttggaaatgcctcccagccctttaaacaaaatgcaggtttggtgcctgcctgacgattagttttagttaactgaaaattataggattgacccaagaggaaaattttgtttgcactccaatcacttttacaaattaaggaaaattaccacaattttgtttagctaaggtttcacactgagttcaagaaattagctcagccatcccaacaaagtcagcactttgttagtgagcacttgaaaaaataatagtctttctggagttttgtggtgtatacaaacgaagcgtagagaaagctatgatgctttatagaagtaggccaagtgtttttaattaggctcattggttcagcgtaagttttgaagaataatcaaactagcagattagctgtttcttttaaagctaggatttcttgccattcatttttcccatgagaacttccacatagcagtgtgtgtgtgtgtgtgtgtgtgtgtgtgtgtgtgtgtgtgtgtctgtgtgcatgtgtgtgtgtgtgtgtgtgtgtgtgtgttttacaagtctcattatggggctgcaggaaaaggaccaattgaaacttctgatactgtaacattccccagcatcattccaatggatgggagtttttcacaatgttcccccactgaactcggtgttctggaacatatttcaaaaccacagaggccaaatgttttctctgagaagtttggactctgtttttggccgaaaacattaggcctcgctggctgcttatttactcagctattaagaacaagaaaaggagaagaaaaagaagaaaatgcttgtgtggtgggaggtacaggaggcaatcaggcatggtttccgctttggtgacaacgtccctgcccattaatggttccattttgtggtcaggtctcatttagaagaaattatttttaatcagtcttcaacaaaatatcccctagagccacctggccataaaagttagaaaaaaaaatcaccctcattaaattacttaagttctcaagagaaaagagctagggatccatcattatttggagtttttttaaacactaaaaaaaaaaattgccatcagtttaagaaatcacatcttagaaaatctatatcacactggaattaagaaaaaagtgttggattttcaagcctagaaaagtagttaagggtaagagcaataagttggcgcatatgcacatgtatacatctgtgggaaatttaaggtatgaaaaaatgcttctggtgatctggcctcaaactgtgggcaccagacaagaagcctttttttttttttttaaatattctagaagagagttctaacctctccccatatcggaaaaataaaaatctgaagaaattggcacaatgatttcccctctggtatagttacttggctgttaacagttattgtgacatcacatcatttctgatgaaagggaatctgtgttcattggtgacctacacatggaccttttgatcattagcattaaatgcctctaccatgcgttgcttgttcatggctggggctactggcctctgtgatttactcagtttacctctgctgtcaccacttaatagtaagggtatagagatggctcataaaacctctctgttctttgtatccaaacaactgctcagatcattgcaaatgtacggccccctcctttgtccacccacagaagttcacacttcattttctttaacatccatagtatttcaagatgtgaggcttggttttctggattgggtgagctaaccctcttatttgttagtgaaatatcacttggaatttttcccttgaaaaatattattgagctgaaaagtaacaccccaaactaaggccttattgctgtttttaaagtatgcaagagagagttggcatttgtagatgtaaatgtctctaaaagtccataacattaaaaaaaaagaaaaaaggcaggaacagcatggcctaatctatactaataaaggcagaccttttggggagggaagaatctgaccaagcacagattgcctgcaagctggctccccttgtaaggatggtaagcaagcgtacatctctccctcattggttcttcagaccagagacgcacgaggaatccatagctgctaatgtgccatgcccttgtgtttgtccaatcagagtcacagactctggaaagtgaatcctgactggattagaagcagaaaagctcaatagcactttctagatcttactttattgtgtccagttattcttatgtaaatgtagggcaaggctgactttaattttcaataaatgttttctaagagaaggaaacaaaaacactatctaatcacaggattgatttcaaagccctattatcgtttctggtcagtccagtgggaattaaatccactataacctcactgccatgtaagggctctccctaatacctttattattctcacagcttgttttcttgcaggtgttacatctttaagtggcttggatcttttcgaatcgtgatctctcctgctaatccctaagtagccttggaagctaataaaagactcttaggcacctttagctgcttcctcaaagtttttgtagttggttttcctgataagaagcggccaattccaaatgcatgtgttgccttcattctagttatattttctgtaagaattttcatatattctcggggaatatatgactgaaagaatgggacaccaggacaaggtttgagcagcctaggggtaccctgagagctgtacaccacctgaccccccaaaagttggtgaaaaccctgatgaatgatcatctaacaactcagatgtctggttaggtcacttatcagatcttttctaccactaacttttccaattccaaacatttttcacccaatttcctgttcctgtggaaggactaacccacattcctgtgtattagcctgtgaactaacttcgaaatgagaattcttcgtggaaatacttcctgtttgtaccttgtgcccagaataactccacatcctttgccaatgcataacacgttgctttgcacataggaggggctattttgtctgcatatgctctgtggaacttgacatcttttactatgacttttaagttttccgttttttctccctatccctcttattttcttcttgctctcccatctctcctatctccctttcgccttcctctctcttttctttactcccctcatcctttcctccctccctcctaaggggatagtacctcgcatactgattgactgcttaggttcaagatgatggatatagattgaattctcagatctaccatttactagagaggttatccttgggacatcatatgatgcctctaaaccacagtcaccttatctttataaggaaataataataataccttgctggggttgtttttaggatcagggaaacatatgtaaagttttagaatcatggaactgtatttagcatgaggctagatactagtagtttccattaataaatggtggccattatgattcattcctttgtttctgagtccctaccaggagtaactattttccatggattgtttatcatccttgtcatctccctagaaatctaagaaatgtcttttgggatttttagtaacacaactataggcatcagtttaaagaaacaagtaacacctgtcaaccccaaataaaaggagcaaagtgtaaataaagtagcaagaaaaagaaatgcataagtgtaaatgtaataatttgcttaaaacaaatatttttgcaggaatgcatcacacagctaatattttaatcagatactcctgatttgtaaagttctctggtgttaacttttttagggaacaacacatgcttgttctcttatttccatctcagcccctcctctggaggtcctagcaacaggagtacagcctatcaccaactgtcttcaaaagtatttagattataatcagcttcaactccagcttccagagttttcaccagaaatctctgtttctcattcttggaaacctcctccacaaaataaaggctgccaccttgggcttgaacaaagtcattggttttagggaagaagtggagagtttgcacctaatggatctcctgcactttagtcttttcttacataaattctttgtcacagtacgctctgaatagccactttcatgtcattaccctgcagagaaaccttccctctttgctcactgtatgtaagacgtagcccaagtcccgagtttggctcactgtgctctggggctagggcttatgatgctccagtcaaaccagtttccttgctgtgcctccagctcactttagctactttgggcatggtgattcacctgaaggatccagttcaaactcttacctctctgaagtgttctctgaccgctgtggtatagtggacagagccctgggctgatagcaatgaggcttgcatcgtatcccagccttgctactcgctagctgtgagacaagttgcttatgtgctctggactccagtctcttcattgtgaaatgagtcagtcggactgactttggtgctccctgtaactcatcttgattgactgggagagtctctgtccttgaatctcttttgtcccaggtgctaaaaccatcccattcatcattcacttccttttgtccttagttctcttgttctgttcataggtagacaaatcataaaaagtccacaagcttcatgaagaaatagaaactcttcctcaatcttattttatacactatgttgaagggatttggctcagcattttacttgcaataggtgctatcattgacatattgcccaggatcaatgggtcttcattgatttttgtcctctggataacatggaatgtaaataagagctgttaattaagaatctgtccctttctacttgaagttttacatacatagaacatagtttctttaaatgaaaaaatgggatttggcttatattatgaatttcattttcttatctgtaaaatggagctattttaatagtaccttcatctaaggagtaaaagggttaatgtatgtaatgcaatcctgagagtacctggtccagtatgagtgctccccaaaagtaagtgagaaaagcagatagtgggtatatatatttttgaaaatccaaagaatttgtcattagagtttgatgttatgtatgtgtcagctttgattatgagtaaagacattgtttctttctaggcattagaataggaataaaaatacctgtgttctgttctgattttaccacttccttttgttacttcattcattcacctcacaaatgtttgtggattgcctgtcttattctaggcaatgttctaaaccagttctaggccaagtcctgaaacagtgttaagcaaaaccagacacaatccctgttttctttattctaaagactaagagggaaaatgggtgttcataagtttactatttcaaacctggtacgtgtccagaaagaaacagcgcttttgatcagcacataataaaagagccctgaccagtcagttagagatatttctctacaggaaaaattgcacaagctgaagtttgaaggatgacaaagagctaacccaacaaccagtgaagggtgggggtagcatggggttagggaatgagccttccagcagagggagcaaatgagaaggccctgggtgggaggaaacacggtaccttggacggctgtaagaattgcagtgaggctggaaaatcaagagggaggaggagaactgtgagacagaaggctgcgagaagtagtcagggacaagggtatgcaaaactttataagccatggggaggagttttgttgttatcttaagaacaatggacagttttgaagtgtctgaaatgacaggtggacgtgaccaggtttacattttgggaacaaactaactctggcttcaagaagcataggagaccagaatgtatcttggaaggcctcttaggaggtcattgcagtagtctgggaaagagatttggtgactttgatttgggtggtaatcagtggagatggaatggagtgagaggaatcaagaggaatttaagaggaaaaatggaaaggacttgatgggttagatgtggggatgagggagacagaggggttaaagctgctagatttttgtctccctcaacttaagggatggtagggccatcacttttctgtgcatcccaaggatcttgtgaatatcaatgaaaaaatggccatgaaaatattttgcatagcgtaatattctatacatatgttaattgttataaagacaagcctaagcaaactcagaaagaattggagaaaggaaggcaagaatgtgttttcttttttgtcagattgttttcacttagggattcagctgaaagagggctgggtaatgaatacttgactagcagctctgccttagcagtgtcctaattggaatagacccaacaagaaagaaaaattcacaggctgctcctgtccacatgtcttaaatattactccaaatgaaccatttacacacaaagaaaagaattcaaggcagagggagtgtttattctttttgcttttgtgatacaaagggtaggtcccaagcctctccttttttttttgttccacaacatatgatttttccctgatcagatgtatgctgatgtgatcagtgattctgaatctgctggcatttgtacagttaaatactgttggtgtcataatgagaacaacaacaacaacaaaagtcactgaaagtaaccattgtacttccgtgacagctataaaatgagagccatttctgcaaagaataaagctgatctgaaggaagcatattattttgcatattttacaaatatactttccaagaaatatgacctttatttcctatttggagtggagtgtaatcaggacttgagtagccagtataacaggatcattaaaagggatattttcactgacattagaggtctaaatggccacgaggccttatatacaaccttggctttttcctgtctacccagagttaataagtgataaggccgggagagagataaatcacagaaatccctgtccaaagaaaacatattgactacagccaagcaaataacagaccataaccaacggtcccattcatcattcatgtaatagggatatgaagtatttcctaccaatgaaaccgtacagtaggaagaagcagataagctggtccaatctaaggcatgagatttggttattaaggaacatgaactatttgtcacatggctttaatcttaagatgtgttgccatttctaaactataaatttctggtaagggattagaaagctattaacaataaaagtaggaactgagctgtatatgtattcttgccaatgtaatgcaacactgtaaagttttgaacctctaatctttttagtatgatataacatgatttggttttcaaagccaataaactatttggaagtattcaagttttcactttttttaaaccgaacatcatgataaattaacccttcagcttttgactgtatatcttgaaattttctcaaatattgtggaataggagtaggaagtggaactctaaatttcttttcctcttttcctaagatgtattccaaatgtttgatggaggattattcgttttacttatctgtgtttgcagtgatgtggatgccagtcctgttcattgttaaagttaacgaagagacgtgggacccgctagggcattcacttttgtttttcattctttactgcaaagttatgcatattgatttcagatcatttaggaagcaccaataaaacataattaaaataatattgaaattgcttacattcctaccggtttcttgttacataaacactcaataaatgtgagctattaatattgtttaatgatatatattttgcagtatttttcctatgcatatatctgacttattaccataataattatatcttacatcatattatttatcttttttcatttaaaaatacataaatatcagggagttatgaatttaaaacaatttttagtcattgataatcatcttatgccctagcagaaccttatactgagatatatcattatcttcatgttaaagcatagccccctggaatttggtttctcctctctttttctttctgaaaaacccacagcacagggtcaataagtcctacacctggattatttggggtcaggatctgaaatttatcagccatccccaaatgagtgggtgtgtgttgctccaaggacccagtgtcctgagagcttgggagcggctcccaaaagcatttagctatatagtgtggcactgcttctgttttcaagctaaacaacctccaaggtaaatgaattccataatcatgctcccctgcttcccgggacccaccacgtgctgtacttttcgtaagttaaaatggaactcatctaaaaccctaacgatatctgaaatgtaatcaaatccaaaattgtaacaaaaaataggtaaatgtaggcccctctctgatcctccataggccagcagcatttcttgctagagctttcagctcctcctttctctccctgctcttctggtttcccacttcagtgggcttttgacatttgttgacttttctcctgttgttctctcctattccacaccttttttttcaccctaactctatcttttctcccagtcttcttgttctctacaattactaaatgtaaagcaatccccacccccaccccctggtgccacccctgagaatctgtgtaagacaagccctattattagcctatttttaacaccaaaaaactcaggtgaagtgacttcctgggttatttagtaagtggaggagccaggacttgaaccctggtgaagggtaccagagcctgcactgagtaagcctcctggcatgctactttaccttgttaatttatggaattacctgattccctgaaatgcagttgttggtgatgggagagtggcaggtatttctaggacacgtgagttctgacaggaactggagccttaagtattttaaccaaattatataattgtgaacataatgcatacttatatggaagatttttaaaatacaaaaaagtatgaaataatgattatccattatttcatccctcagggataatcactgttaatgtttttgagtacttacttctaatatagaaaccatatagaaggaagagacagataagctctcacaatctaaggcatgagatttggttattaagggacatgaactatttatcacatggctttaatctttaagatgtgttgccatttctaaattataaatttctggtaagggattagaaagctattaacaataaaagtaggaactgagctgtatatgtattcttgccaatgtaatgcaagactgtaaagttttgaacctctaatctttttagtatgatataacatgatttgcttttcaaagccaataaactatttggaagtattcaagggtattcaaagaaggtactaaaaaatactcctatatttttatcagcaagtcacaataggtttatatagttttgcgtcctgctttgttgtttatattatacactacacatttcctctgttagttcaaattctccctgaatgcattttggtgggtgtataatagtccatctgatggctgcaccataatttgcttcatcattcctctatcattggacagccatatcttgtctttttttagaatttttaacatcagctatgccagaatatagtgtgattctgaatatttggtgttctcccttttttctagtgaagtttagggcttccagagcaagtaaaccatatacatatttatagataccaatacattatcaaatgtctacttacaatatttcacatataaattttgttacttgtacatgtctaatatcacatacataatttacaacatttacaaatacaacttctgcattttgggtttccacccttaatcaaactttttcaagtcattttttccatcagttgttttaaaaaaatcaaagccagagccatttttctcccattatagtctcttctaagttgtttgtgatacacctctttttaaatctatgcatggtgctttcactggaagatttttttctcagccataagtaaccattagcaatattttaaaaaccgatatttaaaaggcttgttttgaggaatgcttgtaatgataagaggtcaatcctccttaaaaagatactacatttatattaactttctaatcctttttgtcttgactgacttctgcacctccgtaagcattactaaaccaccattgattatgattatttcatgcccctaccgatttaaagtaacataattgagaaagcatcttgctttaaaaatactcaaatatttaatgagataactttttttggagggcaggggatctgcccatatatagttcagcatgctgatatttctttcccgttgctgggtcctcagccctgtgcaatccttggtatgagttgaattatctgtaccacaagtcagatatttttgacttgaataaagtaggctcacccttttacatggacctcatattattcaaggtactgagagtgcaggtggaaaccatcccattaatatcaggcctgagtttttctgcagtatctctcaatggtgagaggtagacagaaactggcactccctaaatcatgagcagaaacaacaacagaagagcgacttcccctcatacccactgctgttcaacctggcacatgtaattgttcatctttttcctgttaacatcaactgtggttaacttctttacatcacgggtggaaggcctgacttgctaggcatagccacctgggatcagcctcggtggttagctgcaggaagcaccaactcccagtcattatggagttaatttagatctttgtttaatgccaaaaatatattcacatttaaatatctgcacaaaatatggccttcccagtcattctacacacgttcatcatttccttttagttttaattgatttttaaaatagtcaatgaggccaggatgactctttgagcttgtagcgaggtttagatgaaggagtgtctctgaataatctgttttcagcaagcttgtaattctcataattctctacttttttaagactagaaaaatgaaacatttgcattggttagctcagaagacataggagggttatctaaaggtttagaaattttccttaataaaattactagcatcaaagcaaaaaaattgttgtgacttactggaatgttctgtatcgggggtcaaagtacaggtctgactactgacactatgtgtctcttcttcatcataatgtttgtagaaacaagtaaatgtacttaaatgcatttttatagttgacaaagcctttctcattcatcaattcctttttgttctttatgaggaaagacaggtatttttagccccattttcaggtgtaaaaatgaggtgtagaaagaagtgaagcggttcacttatggtcatttaagccatctagtgatgggtctgatatcagatctgtatcctccaactagttgattatacctttcaatatcttagatttttatacctaccaaatggacttatcccagttttattccactttttagttttctatgaacataattcactagttagactgggggcttctagaacctcaagctgcctccccagcattgacactttgagtacatgtagttcttttattgacagcgctatcaccagctgatacaatctgaattatttctttgcttccttgtgtgtagcctgtgtctctcactagattataagcttcctgaaggccgtgtccttgtctttctcaaccagtgtattcacagtgcccagcacggagtgagatgcaataaatattagtcaaatcaatgcattaaaaaatgtgtgaaggaatgactgacaaatgtgaccttaaatatatgggatgtgagtcttcaagataatctagttgtccaagttgttgatgtctttatagatggtgaaaacaaggcttacagagttttaaagacttggctaaagtctgtcagttagtggtagatatttacaccagattccttttcttccacctatcagccaagagcttgtctccacactacatatattttccttaggctcacctagttataaagaaactgtatgactatagagctctagaatcatgacagatcccagtttgaatcctggcccaaattcttgccagtttcttaaccactctgagactccatttttctcatctgcaaaataggaatgagaatatatcacaggactgctgtgagggtttgataaggtcatgcatataaaaagcttagtacagtgcatggcatacagtaagtgcctgattaatggtggatcttatcaaaagagcatccaagagaacagttgcctgtaattttgagttttagagttggaaaggtcctcagagatagcctggaccaatcctaacattttgtagaggaggcagctgaggctcagataagggaagggtctttcccaaaccaacacaggatgtatttgcttacaaaaccagagcagatcacatataaatggatttactaattactttgtgaatagattcccaagtatgcaaatatataaaaacataaaatttttgaatgtatatgaaaatcaatcaacaaacatcaccatggtcgtttgataaactctttatttctctaatttcatgaatctttcagtaaactctcaaggaaagggtgaggtggtatagacgcttaattccttggaccttccaatatgtgatatgtttacaaaaagggtgtcatggacatcattattctgatttgtttacatgcttttctgtctgttgacaaaaaagaagggggttttcttgacctctgagtaaatcaaagccccacagaaaagccaagtgccattttcactgtgggtgaagtggagttacgcaatttaaaggcatgtcctttatctcatctttttgtgggagcccactgtaagagcagggcatgtcagacaccagcacattgttggaagacctcattggaactggtggatcatattccctgggtccatttggggagggacttagtggggtccacccaaatatactgtcccctgctgcactcttgtaatttaatgcccagtggagacttttggtgaaattccctcttggccacaaaatgtctgtggaccctcctttgtgcctcagtcccctggtggtccttgaggagataagatgtaaatgcctttattcggtgatcttctgcttagtgggtttagaggcaaatcattaagggccaatgagagagaaatacttgcaagatgatggtcatcagggataagattaaaacctgtttgagaagagatctgtgctgtgttcctggcccagtgaagttactgtttgtttgatgcccgacaggaacgttgactggctaacaatgaacgagtccagaaagtgttgttaggattatactgcggttagaggtgaggagggtatcattcaatttttccatggcatatcccaattcataaaaaaattagctgggtgcagtggcttacgcttgtaatcccagcactttgggaggccgaggcaggcggatcacgaggtcaggagatcgagaccatcctggctaacatggtgaaaccccgtctctactaaaaatacaaaaaagtagctgggcgcagtggcgggcgcctgtagtcccagctacttgggaggctgaggcaggagaatggtgtgaacccaggaggtggagcttgtagtgagctgagattgtgccactgcactccagcctgggtgacagagcaagactccgtcccaaaaacaaaacagaacaaaacaaaaaatcaagattgtattatataagggatttctgttctaaaccttatttggggcttgtgttaggattcaaagaaaagattttgtttccaggccttcctaaaaaggcactcaattattggtgaaaagccaaaaagggccagttgtccattgatgctacaggtaatgagtagagtaaaaagtaaaacatatctattccccttttccaactgcagctaattaagggtagctcatttaaaaacagacctaatttaatctctaatataagtattcaattaaagttgttcccgctgctttcttctaagaaggctgctttatacatttatatatgatgcatttatggtgtgaatccttctaaggatccaggtggtaatagaaaagtgctttcaggacttcataattgcccaaattaaataatatgtatgtaaatgggggttgaggtataaattgtgcactgcaatgctataaggaattgagcccctatatcctgctatcttttagccaaccagaataaagtactccccattttattctatactacttagaatagtttattgcattattaagtacatgttacaagaagcacattgttgtttaagactcattgatttaagtagaactattcttataaagttccataggcttttacataaaaagagaagagcccgtataaaattataaaaccttaatgtaataaaacagcctataatataatattctcccattttctaaagaaatcaccaaaaatttttaatgagtttattagaaccactgtttgtgaatcctgggatgtcatgtctaattagacttaatggatttaagtatttctttaatgaaatctctagcttaactcaccaggattatattccttgtcctcctgcccttcaaatgattttactttatttttattttgggtagcattaaaaagaaatgaaagactatgattctgcctcattctcagatggatatagtgaaaaatacagtgcttattatgaagttaatgtgaattaccatgtaattaccactggctgcactgtaatgattatttagttaccactgagcattctctgccaaataacacacattatttcataggaagcatagaattaactcaagtcatcccggaactcggggagagagtatattcctgatctctttcgttgagtgtaggcgctgctaatgttaacatcgaaataatcaagcttggagcaaaccgacagcagaacaggatatgagtttacatgatttgatttgctgatgttttaaacacttagcaggagacagctatagaagccaattaaatctctccaaggtgcatagagttatctcctttgtgagaaacaatttaagggaattgcattggccctttaactgaggggagaaaaagcattaggaatgaaatttcagatgcaaagtgctgatcaatcctgcctctttttgtgtttttcagctttgtgctgtttgggctgttgctattttaaaggatttgcacttttattttgcaagcacagggttatgttaaacttttctttggctattgattatgacgtgctttaaacaaggcattgtgtctaaaagagtaaaacaaaaacaaaaacaaaaaacatgtcagtacattctgtccctttcagatactgcatcttatttagtgtaccggaattcccagtttaaagtaatcacaaaatttatggagaagcggataaaaaaggttgtaaaatatcgatttgaggaaaataataacacaactcatctataataagaagaaaaatgaagcaataattcagggggtatcgagcggcttgctgctgggagtattgatccagtcctttacggtataagatcgcacctgagattgctctgaaagaaagaacagcattccttcgctcattatttcttagatactatcgccttgttacatgggtcctgcagagttggaatagttgcggctgggagagtgggacctgcaataataataataaataaataaatagctcagaaatctatattgccttaaagccaccatgcctggtcttaataacacattggctctggttttataagttcttcattgccttatagtagctaatgacaattcctatgttgtgtggttcatttaggggccgaacagatcttcatcttatataatgggttctcatgtttggaaggaattcctgtcttggctgttgtatttcttgttaagtcactaaattgaaaacaatacacttatgccacgttgggccatggaaaatgttggcttttgctttaatggggcattgttttacattttaagacaatttttggactcagcaggactatgatggttcctgagcaaaatctttaaataaatttggcctgaaactttgaaattcaagttcataagtcatgaatttctgatttgtgataaccgtgaatttattaattcacctagaatttctaaagtcttaaaggacaaatctacttggcaatgtactatcatcacagtgaggccttaaaatggcagactgtatttcattcccgaagaattctaggttcttttcagactttaagatgatcttacaagtagtattgaggaaacatgaatattttgttgtcacattattttttttttggaggggagggtgcaataatattcaaattccaatttaattaaaacattttgaatagctattatgttccaggcattttctatgttctgtaacccagaaaggtgaggttcttgcccccaagacacctgtattccagtgaaagaaggcaggcaatacacaaggaggcagagaagataataatcagattggcaaaagtgttaagaaagaaatagggaggatgatctggtacagtgcaatgaggggagctagaggacttctttagacagccatgtgtaccttagaatttgtacagtatacaaatggatagcactgtaagccctcacagcatcacccaggtacacttatttttatttccaagcatctgtggactttccccagcgctcacgctatgctatcatttgcccagaagattcactctccctatcccatcccccagccactctgtgatcattatctagaaatatgagccgtaccagctgactatgttctcagtagatcaagcttcctgaaatttcaaaaacattgattcatgtcattgtagcagatccttgaaactgttgtttctgtaatatctgtctctccctttctgactctaaaaaaataggtccatggaacaagaggctcatgcctggtgacaataaaggcgaatagagggggaaggatggagaagcagaaagaataagacatctaactatcaagactaactcccaaaatagctttcaataaactgcaaagcacacccctccttctttatccacatagtaagattgaaagtcgtcactgagtcttaaactgtgaatattgaaattgtgagatgtatggtacatttaatggagacgttggtgaagtgcacaagtcattttaactttgtcttttaattttcaagatttattggttccaagggaagagaatatttataagcgttttaggtattcacaaaacatgtagttgccaaacagtgcaaagaatgaaaagaaatcatcattatgaagctggatgattcaggaaatgtggtgataaatatgggagtgacaacatattatctcagccttttctagctccacatttttgagtcatgattatcaagtgtatcactgcagggagtatgctaagtcagtttggagctagaggaattttagttttaaaagaataaccacgccatgtttgggaagtacaaatacagtaaatgatgtcacgtcatctcagtttgaataaatatatattgtataatttgcttctgtcttttaatttctcataatgaaaagaaagtggcaagcaacatgaaagcaattaattgcaacaatgattacttagcttcttggtgcctgaattaaaaagaatattaagattacttttctaatagctcatatgtttttttaaaaaagtcattgatgttttataaagggcaggtgcatttgaattgtcctaaaacactagtttttcccttgtgggcaaacagattgtcaaaagtcaactgttggccattctgctggttgtttcatagtgtagtctcaaattcaggaagataaatgtcatatcctagctaatctattgtaatccttctctgttgtgtgcttctttttaatttgagacaggctgattattgaaatacaaacttgtgactgtcactgtgattttcttacgtgtataagtcctctctcatcagcccagagctttgtattcagcagtacccagtagatgttaagtaaatgaatggatcaagagtcaagaccttgccctctggccatagagagattacattatcatttaaacctctattttcttacctcaataatggagaaaataaataagcatatcttcttcactagtttgttgtgacaattgaaataatacgagtaaagtacttggcacatgataaaaggtgcacatgaagaactcaaaaaatggtagctgttattaaagactttaagtggttctcaatctgtgattatctcagagtttacttccatttggtttacaagtgtatttccagtgcctcgtactatgccttgtctagaagatgctcaaaaagtgcttgctgaatgaacaaagcccccgattcttattaataaataacaaacagctactgctgctaacactcacaaagcacttactctaccacacagttttaagcactcaacatatttttagacatctaatcttaaaaacactacaagacaggtagtattattatcgctgtattacaaatgaagaaactgagtcaaagaggtgttcagcatttgctgaaggttatgcaactagaaagtggcaaaggcaggacttttacactggcagactggcttcagagtccaggctcttgtgcgtataacatgatcttcagtatttaggcacaaaggtaatggaaatgttgcactgtgccccatttattcattcaacaaatatttattaatcatcctcagtatgttagttaccggagataccacgtacataatgtgcaaagatgtgcataatccctgccctcatagaaattatagtctaacaagtctgatttcctcaagtttcagtttgttccatactttcctcagtgactcttgtaatgagagacagttaaagtctgacttgatgcagtagaagggaggctataaacatttgcaggaaggagagtgcaggggtaagcctacaagggaaacagggtggtattgtactgatcactatgggttacccagcagagagcccgccttccctttaggatgtatgcatgtagcatgccttttgaagccctggatgccactgaagcccttttctcctctcaaattttgtaagcagatgtgtggtcttgccatctgtaccaccacactgacatctgggtccaaactgagcaaagcattgttccaatttagccacaaggaggcaagctcctggctcagcctgtgaagggtgatggggtatttggaatgagcccactttctttttcttttttttttttttttcagcatgagggtgagaagtcatgttattttacagaaaggctccactaactttgtcttttatgtccagtgcctcaacttcaaggctacaggaattagtgcccacgtgtccacattttaaatctgtggtagaatgtcctaaatccataggcacacacaaaccgtggcacatgcatgaatttcacactgttctgcttgtctctccagtttgaatttgccctcttcattatttagttaattcatttgttcattctttcattcattcatctatttctttattaaatgtttactggggaattaaaaaaaaaggcagctgcaaggatagagtttgcatgttaggcaccacaagcacaatgactggcagagagttaaagtcctgtaatggttgtcagataagtggattgatgaaggaataaaaaaggaattcaaaaaccattacgtttatacttcaagaggttatttttaatcaggaatggattcaagtaaaatattctaagtaatttttgaagaatgagtaagttactcaatttaaaaaaataaagggggcaaaagaaaaaatcaaatttgtcccaacagagttcagtgattttacaaaacaaatccattgatctagactctcccagttttgtctgccttttcctgtgatcacaggtcaagatgactgattaccctgggaaacacgctatagtctatctcataaacagaaaaaaaaaaaattctcacacttggtcagaaggcagccaaaacgcttcatctccagaggctgggaaagttgatctgtggttgagatttggccagagggaaacagcctgccagaatgagagcctggaatctggggggctcaaccaagactccagtagaactcacctcaacagcccaacacattcagcaagttagcagccagggccaactacagaacttagtaaggtttgctgctgagctctttaagctgctaaagtaccattgacattttggccaagttaggaaatttaagaaagagagccttaaaaacaaaagtatctgatttcacactttctttttttcaataggaaaacttccagatgtctttatctacactatttcgttcagaatcataggtgatctttcaccaaactatgttttgaatatttgggcactagtttttgcttccacggataggtcctgacccaaactccctcaaacatagaggttctccccaaatcctatcatggcaaccattttccatgaagcccctctccctccaagggcattgtaccaaggcccttgcaggcctcagcctttgttttcttttttaaaattctgtgggagttccaagtccatcaaatatctcaaaatgccttcccaatccctgtatttctttccacttttaggccttcagctagttaatcccaataaagatttaggagcttgaaaataaaatgaacttcctaaagtagaagtctattcgtctcttgaatttcattctctgccttttattgaatgtcaactatgtgcaaagtgtggtacaaagcactaagataaaataggagacaggtgcagagcaaggatgaacaggaggcaggctgtgctggcatatgatgcaaatcaaagtgacaaaatgctctggtagaaatctgggtaaatggctagggagaagacagcctaacctgggagtccagggaactagagaagtggggaggggatatggccagggggctcagggtaggaaagattactttaaatgtgtgttttctacttttttcctaattactgagctccatcttcttaaaattgggcaatgggcagtctttatatgtgaaaaaaaaacaaaacaataaacattagtttataagaaattataagaaaaactctacaccatcatcatctatcccccttttaattttacttctcagccataatatgttctacaatagtccaggaccttatacaaatgatgtcccaaactcattgttgtcattgtcccactctgtcctcttaataccttatctccccgacctctcatgagagatttgaggttacttagggtgttttcattttctttatcatgctatggaaaagcctgagcactcaactgaattcaattttaagtaagaaaaattccttgcaattaaaattgtttgcattgaattgagtagagtttccaatattcatccattgtcatctaaatacttttgtttagagcaaaataaggtgcttattacaatgagtcaaatatttgggggtctttgtcaggtcaggatggtgtttttgatctggtcaaaatgtagtatttgctaatactttttctaactagaaaaaaatccaatctgatatcatagatttggaatcaaggctggtgagtggcataggttgaggaggctcttttggaaaagttattgacagaataaataaatgaatgaatgaagaatactccagcctggatttaagagtaaaccatatcacttgcttccttctcaagatggccttgtgtggattcttatgttattgaagctttggagcattttgctaggaaattctttccttctattgcaacatcgtggcgatcaggctgcactgtcagttgagcactggggactgagatgtttgtgaatgctgtggtcagtcaggtctgagttcaatgaaaagtcattgcctgagggttgcataacttgattgctacaggtagagaatggcctttcaccaacaccaaagatttattggcttttgggtgggaaaagtcagcttttatatttcaagagagtaaatcatctcttgttaattgtgaagcctttaaaggctatttaggatggtgaacttctgctagagcttcatgcagtaatatgtaaaatatgtagttgaccagaagtttacagttttgactaatagaagtattagtcaatgggtaatacttcaagtttgccaagtcccagcttataactggaccttcataagccagcctcatgttctaacagtcagaagcactctagactatatatatatatataatttagaaaatttagagaaaaacaggatagaatttaaggagttcaaatcatccaatagccatcacccagagttgaccactaaaaagatttttgtatatttctttcatatttttctatacataacaaatatatatgaacattttcttcgtatttgtggttatactgtatatgtgtttacacacacacagttttatatcctgtttttttcacatagcctaataagcattttcccacgcattaaaatttcttcataaacatgttaataggctgcatcatctcccacagtgtggatttactatatttatttatccattcactattgctagaaatttaagttgttttatttatactcgtataatgatacaatctttgctcttttctctaactttgatgctttaaaaaccatagtaatttgtggtaactaaatgttctatccctttatgaagatttttttttaaatgccctaaatgatttttttttgcaagtggtagatttttaaaaaaaacttttgaaataattttttcatataatgcttttattatttgcactataaaatgatgctataaaatatagagtagaaataaaatatgcccaagtgtccacatgaactcacaattagtctaggaaattatatctagccgtaaagtgagaatattaaagctcttgtatctatattaatacaatcagccatactttttaatgataagtatttaatctatcagtctcctctctcttttttatcacccagttgcaaactagattcattttggataattacctttggtactaaatgtatattatctgcccagttaggaaatagatcagagggaattcataaatcaatagtaataaagtaaacagagagaatggaatctatttcctctcttatcatttgtttgaacccatgctactaaagacagggaccctgtctaatggatgtcggacagaggaccacaagtaaaccccactgggaacagctctcctttaagaattgatctgatatttcaggaaatatcttattgtttgaatattataatggtaggtgcttaatgacaactacgatgctttgacttctgctgtttacagaattgatttcagtttctctttcaatgtttttgtatctattcctggatgcacctcctttctctccaacctctttctagccttcataaaacaatttttgacagagcattaatgttagatttaccagtgttatgctaaccacaatctcattgtccaaagggagataaaaatccagtgtcccatactgttgactacaaaagaggctctctgtagtttcaatgttgatgtcatcatgagaaaagataattcaatactcagagtgggacctgtacctctacttcagcacaaacatgggagagttagtttaccttgcccagacctctaaatattctagcaggctaatgaaactctgagaaaaggtatgtccagcctcccttgttgatatgctaaatccaacagccaagaaaatattcctgccgtgtaaaagaaactcatcactgctattattcagtgtatattcacctccctcgtgtaatacaaaagtattacctgttttccccaaatcctaaactctataggaacttattgacttatgtcacaactaatggcattgctaggaggtatactagagcccactttcacagttttctaccaagtgttgacttcactgtagcgtggttgatcctagactcaagtgacctgatttggtggtgccttccacaccaaagtttcaaggccaggaatatagtgagttaggaatctctttctgtgtttacaggattatggtcactgttggttttagaatcttggccaaggggaagactattagattctgagtttatttccaaagcaaaagcaggaaatctaaagagatggcattgcatattttgggaggtggatcttcttcatggtttccagtattttaatgacaattagaaaattgtttttgataggatccaagtagttccaaattcagaaagaacttaaatacgcttctgtctttcacaaagtccaattgtaaatgatgtctttattagcagagatacatactcttgcacccttgtcactttaagaggccacatactcgggaagaggtatgtgcttcctcaaggagcttgcttctcctggcatagaagggcagtcaatctaggccctcttccacagggaattgccatgctgtgggccacaacttgacaagattgccttggggacacacctcaaactcctgcttaggtttttctgctctggagagacaaagtgggactttcaaacaggccaaatatttcaagagagaaatctgcaattagttttcttcccccctcctttgatcattataccatccttttacatctgccaggctctatttacaagcctcctcttccctcagtaggcacatttgaagcctgcttaactggtattcagagggcagaatggcattatttgtgattcctttgccactgactcggagcagtgatgggaggacgtcaattttgcaagggcagcattatttgacgctcttactgctcagtcccagaacgctcgtttggttgtgaagatgagcacttaatatgctctcttcttttctctcctgtcccttccatattcctgctgaatctcacattcctctaagcacagccctgagaatgccagccttcagacaagccagaaagaagacactatgtgaaaatggggcattaatggtttgtgaatccgaagatagttaactgatatgtgcattcaattaagattggtttttcagttaaaagactccccaggaagagcagctttattctcatttctgggttatgagcagttaatgaagaaggcataccagaattccacccgtgttatccggagctacctctggattccataaccattttcaacttacttgatgaggggaaacttgccagttgagattaaacaagctggacgatggtcatggagaagcgtgtgtcatttcccatgttttttgtgggtgatgtcaccaccacacaccgcacagaaactggttttgtatttaagtgtgatccattctggcaactttcccttttaaaacatatgtcttaaccaagtcaagtctttatgtagcatatgtggatatacatttatatttttcaagtctaagacagatatttttactgtaggcatcttttactatttgttttctcctgtgttgtcctgaagggaaagataacaccattacttccaatgtattagctaaatgcttccacaggggcagtccatcacagagaagccagtgaacaatagtgacagcctgccctggttcagctcttactgctgtgcaacttaggcaagatccgtcacccctctatcgtcctaagggtctttctcctgtaaaatggtgatgataacagtacagacttcacagagacagcaaagagttggtgatttgtaagatagtgcttagcacagtcactggcacaaggtcattgtgcatcaattactatgaactactattcttatctcatttccattacaagaatgtaggtaaagtcacagcatgttgtttttagtcttggaggtttttgcaaaacagcctttaaaggacagcttggcaatggctttaaaacatgcggatgctttgtagacatggtccatgatactttcagggtcctgggaacatttgttgtcttccttttagttggtgtttgttttataaagtggcaggtctatttggctttgaaatggccagcagtaataggagatagatcatgtatatgaagatgtcatctgaatgacagatttgatgttgtctttttccataggtgcaattcaatcacatttcatttctttgcctaccaatccttcacccaagactagcagccacagttttctcatctgtgaaataggaatatctaccttttggggtatccaaaggaaaaaattaagtttgcaaaagtgaaatgctcagaaccgcttctcaacaaatgatcctatttattttaagtcaggcttacatggaggaatgacacagaggactggggttggttcggctccaacatttgagttttagttgtgattcagctgttgactagctgttgatcttacactggtcacttaggctttccaagcctggttgtgtttgctgaaggaagatttttgcagtaataaagttctgaagttgattgagtagatgtgcctttgcccctctctacctgaccacatcaagatcacactgttaaatctagagttagaagggagacttagaagaatgtattcgtatctaaaagttgttttggtagcttttgaaaaatgcaatccagtatatttgattttgtccttaaagggtcacaatacctattgtcccaatataatcacaaaaattttccatttgagaataggtcagcagtttatcaagccgatctctgctcctgtagatatgtcccagccctctgaaaaagccagcaacaatatctcacatattggtctcaggcaaagtgaattccgcagatggagctaaatatgtatttttatttcctctaaattcaccaggcttcaataggagcaggaagattatagagagagtatagaaggaaggtcactttttttttccttgttggttttaagcaggtccattccacccatcaatatagagagaaatgcaagattcagtttggggaacttcagtctcttaattccagttagaaggaaaaagaggtccagaggaatcttagcaagaacaagggcttctggtaacgctagatggcatttctaaaggcctttgcccacttggaaaaatagtttatgtggccactgggcctacttttggggatgcctctgaacttaatacagatccagtctctaagcttaaaattctttcatcctccccacccaaaatagccagtttgccctccagaaagcttgtactgatttctaaccaaccttctgggtataagagttctcattatctccattaaagttgctgttattaagaatttaaccaattgtcacttttattagtaaaagctaacctacttttgcttcatcttgtgctgtgacaaatgctatgctctaacagcgtcctgtcataaagtcttctaatgatgcgtgtaccttaggagaaccatttgcagctctcagacaagctaaacagaaatattaaccacgagtcttcccccaagctggaaataacccaaagcagtagtaataaaaacttaaccatgatgtcctgaaacatggactgtgctatcctatccttaaaagttcagggcataactttagctaagcctctctttcactccctacactcacccacattattccatgggaattaggaaagcctctctagcacttgggatggcacgtgaaagaaagaatcagagcctgaaggtggaggctgattggtttcttccacttaggttagtggattaccagggtgtttgcttatagatcaacagcaacagccaacattattttcactttctcctggacagtgtggtccatattccaattagaacccccaccctccctctttatcctctacatttagacaacaaattatatccacatggcaatttctttctaatgcagttaccagacccctttctttggggcctaaattcaaatgagattatgaaagcctttgggtcagtaatgtagcaactggtctagtctcttcagctcttgagaactgatgtaggcactaatgagataaattcactaaaatgcttttacatggagacttggtaaagatacacgacacaaagagtcttctgtgtacctggcttaggtgggtgggttcaaaccttttccttgctgaaggtcagaaccagtgtcaaatttacagcaaacccacttttgatgcttggtgttccctttggtttttatcgtcacagtaggtattacctgaccaagaagtaattacaccattattttttatgtggtgctttattacttgcttttcaaaattggtttccaccatctcacgagctaatagcaacaaatatgtgattgtaatgttcactctgtcaggagacccggggttattgcggaagtggccacatacccattgcccacacaataactgttactccaaaacaagtgaactgcttaactaaacatctattgattgtaagacgctggggaccaatattaagaccaccaacatccaaaggggaagattaaattctagttattatacactatattttgtcaatattttgtggcgaggagacggagcacaagtccaaatctagggtagattagaagaagtagaacttcactgggtaccttaagtcattaacttagttcaatccacttcttaaaagacaggcattaagagtgtcagcagaaaacatcaagaaccatggaaatcccctcatcttcactgctccaaatatactaacaggaattaaccaaatctaaaagtcagctcaaggtttatcatcatagttgtttccggtgaatgtgacagcttttgccttgaggcatctgaagttctacagttttctttaggactggggactgatctgggactgagtgtcctccacgctttcttgtatggctcttatgataagctaagctacaattgggcaaacaagtttgccaacctcacttactcatttaggttcatatctttttactgggagttatagagtgagactgaagaaaaccagaactttaggattaaagcatccacaagttgtctgaaactgtgtgtgccatttatgctaatgatcttagtataacatttacaacttcctaatatactaatttacaaatttgcttacatttacaacttctcctcagacctctcctggttggttgcttgactgcactagatggtgttgataacaccttatattttgagttcctcgtttcggtgatactattctctcctggtattctttctatacctttttgacgtgtatttgtcctgttttgtctctcaatctctctctaaccattccttacctgcttgtgttccccgtagtgtctgccctgggttctcttttcacatgtggtttttgctattacctatatattggtgttcctgatagaattaactccatcactgatctttttcctaagcttctggttttttttttgacagtgtctcactttgttgcccaggctgcagtgctcactgcaacctccacctcccagattcaagcgattctcctgcctcagcctcccaagtagctgggactacaagtatgcactaccacacctggctgatttttgtatttttagtagagacggagtttcaccatgttagccaggctggtcttgaactcctggcctcaagtgatccacccaccttagcctcccaaagggctgggattgcaggcatgagccaccgtgcccagtctgagcttctgttctttattctcgactgtctactaaatatttttacctagatcttctggcacctaaattccagcatgtctgaaattgaactcatgattttttttcctcctgtatatagttttctttctgctaaatggccactgtttccactcagtcagataaattagaaatgtcagccatcccccattcttcgtattgccttacatctggcatgttgctgaattcatgtagattttattctaaaatatctctctgaaatctactttttcctccatgaccaccccatcattagttggtcttttattttccatttggattattacaataatgctgcctttaagagccaaccttcattttacttctatggctctttaaaatgttgatcacatcgtgttgctcctacgatctggaaaatcttaaatgactccttgctctctacctgctcttagcaaggcaccaaggccaatactgttacttatggttaacctttaacacctcactctcaacatgttaagctgtactctgcccaaactggaacatccaaccctacttgaacacatcttttgtataactccctttgctctttctgttcctattgcctggaatgcttttcctgtccttttccgtagaaaaatcctatttatctttccatacccaactcagatatttgagctaagtatttccctgactctactacagagaattaattttttcctccttttgtgcagtgtacattaataatgctacagttttgtatatttttgggtagccaattacaggtctgtctccccactggaccatgttcttctcaagggtatggcacagtgcctagaagagtttttcaaatggaatcaatcatttccagctggggactcacagggcactggacttgcatgttgtacatctttttcttttcatcttcttaagcatggggccttgtatacagcaagcctgcaattttatttaattaattaaacagtataaaacaccccaagtctggaaatgaatcctgtcttaattaggtgtctcctatttttttctcctttgttcacagaacttacattgttttaaaatggttgtgtcctactccagatggagctcattttcagggtaatatttgagaaccagaggtggtagaattttttaaactgtaattccaagttagcataaaggagatggggaaggttgagtcccaaggacaagtgtaacacacccgctgttctagaaccccacatcttcctgctgttgtatttgccacactgttttagaattctgtttgtgtctttctgcccctctagactctggagttccttgagagtggggaatatgtaaatatgtctaattagtcctgtattcattgcacctgcccctgtttctagcacatggcctatattctattaatagtaataacaactgcctattgagtatttatgtgctaatcactgtacaaataatagcacattaaatcttcactttacagttgaggaatacttaaagaatgtaagtgacttttccaaaaggaacatatatcctgtcaattatgtagcctggctgcagtctagctgagtcttactccaggacggttgggacaaagggaagaagaatgtgttattaggaaaatggaagtcaaatgggttctggagtgttttcatggaatataaattgagacaaaggaaaggactaaaacagattgtagatagaaggatacatgaatagcaaaaacagtatcacaaaagtcctggaagccaaaattattagagatctgctctgaggagcccttggttggcctaacttgctgctctaatgaacaggttcagagtagggctctcgaggcagactgcctgggtttgaatcccagcccctactttcattagctcggtggatttaggcaaagtctgaactctccaagcctccattttcttctgtgtctaatgggaataatgatagtacctccttatagagttgttgtgaaggataggttaatccatataaagtgcctggcacacagtaagtccttaggaagtgtgagctgctgttgctgctgttgtaattattaaaagaagacaagatacacatgaatgaatgtaattcattgtggcacttagcatttaattaatattatgcttctcagtgaatccatgttttctaaacttatcaaccaaggtgtccctacaaacttaatgggatgctatgagatatttcaaacttgagggaaacagtgatacttcaagtacatcagatactgtataaactaccagtttaaggtagttcaaaactcaatattacattatactgcttttttttttttttttttaaagacagggtcttgctctgtcacccaggctggagggcagtagtgaaatcatggctcactgtggcttggaactccccagctcaagctgttctcccacttcagcctcccgagtagctggaaccacagtcatataccaccatgcttggctaattttttaatcttttgtagagacgaggtctcactatattgaccaggctggtttcaaactcttgggctgcagctatccttctgcctcagcctcccaatgtgctaggattacaggtgtgagccactgtgcccagccttacagtgcatccttttgatggtgtcatatctttgcaaagctggttttcagcatttactgtggttacaaaaaaaagtgccacgtgaaaaccaatatggaatcaaaaatgaaggtggctgtgtttagtctgattctgaggtgtgcaaagttgtgtggtgcccaccaggaacacatgtttcactagtaaattgtgattattttaaaatgaaataaaatgttatatattttttgtccatttctttatatagtttttgtcaaatatgtatgtcctactaagttgctggaacataaagtttaagctgttcgcatctaagtagttaataaacagaattgttgggcattgcttttggcttagggatgctttgaagggattgctgagatactcagggtactgtgaacagagaaagtttgaggagctctgaagtagtagacaataaatgtataagcaaaatgtgtgttaaaagtgttctagagtataatagtcagggggaggagacttcttaggatcaagatgctcagcaaaaataatcatttaggttaggtcaatactgaagaagcctgacttcatttatttttaaatcaagatgctatttaagttgaagctttggctgataaaaacttccaggcttatctgcaaggccattgtagctcgctgcatggcatacttgttgtaagttctctgtaattccattaaaatgttaccaaataatcacttaatcttctaatatcttccagttacaagtactttcctgtcttattagtggaattagtggatgatttggagtcacttttttatcaccattcttgggatttgttttttcctttccagtctgaccgtctgcagagctctgttataatttcattacaactcttctgaaacctgtccactggtttggaggaaacaactctgtgaacagtgggagtcattttctgagttgtctcataaaaccatgatattaacaatcacaagtaggacttcagcccagaactccgcgtttggttagcacaaggctcagggaaggatttcttcgccttggagcctgactcggtgctgtcccctgctgagagccataagtcactggtaggcttgttctaggagagtaataagtattgttgtttagcaattgtgttgttgaaattcagctccactatgtctgacagtatttatctaaaatactttccctggtgcgtgttcaagttccagtaaaccgtgtcttattgtgcgaccttttcattttccagtgaaaagggatcagctcgtcagataaaagctacaagccagagtacaggaaaaatgcgtgctcagaaaatccaagcatgattgaaaacaagatgtgttaaatcaatgcggtttatcgcctgcctattcccggcaattgctgttctaagctcattctgaacacacacggggtgataaaagtatagtgtcacagcacttgctggggtggggatataagaaaacatgtttatcagacaggctgggtgattttacccccttgataacagctaatgtcaaaactctttgggaagaaatctgaagaacaattatagaagtaatattactcttgttatatcagaaactatgccagtagggaagagaattatggacgtatccttaaatgttaagaaagacagaatatgttggtctccaatatttaaacgccatcatccattacaaagtggaaattattcttctcttctcatttaaaggagcaaatttggctttgaaacctaatcgtgaatgatccaaattaaaaaaacacccaaatgaaaaagattgaaaggtcaaaaaaaaaattgtgtacattcaacttctgtttgctcaagggattttattttagttttaaagttggatcaaatttgggaatctaaattaaggctcctggacggccatgctgttcagagcactttaaacacagtaacaggggcagcttttctcatcaactgtagtacacttagagagcaatacagtttctcctaattattggaggttcacctacttcccattttagacacagtatagccctccagggcaagaaaggggtctgttcatgaagagatgctccacttctgccagtaacttctcaccacacatctagaaaatgccaaccggttgtagtataaattggtttaatgtatctcagagacagcatttgtgtctctttctctctaaagtcaaatcagcatttgagagctccttgtaggcttagaccaataagaagaacctgatggacagaaaacagtttcttgagcatttgggggcaaatttaaaatactagggtggcctccccaaaaggtttgtgttagttgacatggtgagccttacataataaaaatcaggccaccaaacggcttgttcatgtgtaaaatgtcaggagcctaggcacagagattcctgttagtgctgggattttgtttcacggatatttagtaaaaacaaaaacaaaaaacagcagtttaattgatttggtatcaggacttgttaatgtgtggcaaattgaggttcatcaatattaacataaaatagtcatcttggaataataaaggactacaaaaatataaacaatgaggcttctgtgctaatttatgcaaccaactctttctgtgcctcagtttcccacctttgaattaggagtaatttttaacatttacgtcaagggcatattgtaggaaccaaggagataatttctagaaagcactttgttattactggaaaaagagtcttatatgacctcagggtatgtttaaaatggcacctctacaaggaatcattgtgactgttaacacctacaatcttcagaggtccttataacttagagaataattgagttcaagatgcaaaatcttaaaaattagttttcttttgcagatgcctttgaaagtaacctgtcaaaatgtaaattggcataaattttatgaaggatagttaggaaatatgtatactgaaagacttgaaatgtgcatattcttttatcctgagaagtgcttattataaatgcttcttaagtcagtgaaaattttgggaagaaaaccttacattccagttagtagaggatttgttacataaattatgtctatctgtataatacggtaagctacaaacatcaaaaagaaagagataggtataagcctgtatataatctatatttttataaaacagtattgtgaaaatgtttggaagcatacatactaaaatatcaatcatgcttctacatgaatggggatattatgggggttttcctcctttaaactattttttatataataattatgttaacattacttttagatttagaaaaacagtaaggtgatttcattttgaaaaacaaaagcaagtctcttaattctttgttcctcttcttgatggcttttacttctccaagaattgttaatttccaaacatatgcaagttctttgcattccaagctacagtcctgaggatcttccctcatcagtcttcctccgagtgcccctgctttgtttcatcctcctaggctctttgcttttcagttgaccttctgtcttcagccttttctttgcatgttaccctggctgcactctttgtaaaaaggacgtaaccactcaaggcacctaatacctctgattgtgcctgtggtagagaggccttgcttcctttgcttgatttttgaatctcaaagttgttgtcacacatcaagagacctgaagactacaaataagacatcagggtgatcggacgcggtggctcacggttgtaatcccagcactttgggaggccgaagcgggcggatcacgaggtcaggagatcgagaccatcctgtctaacacggtgaaaccccgtctctattaaaaatacaaaaaaattagctgggcgtggtggtgggcgcctgtagtcccagctactcggaaggctgaggcaggagaatggcatgaacccgggaggcggagtttgcagcgagccgagatcgcgccactgcactccaccctgggcgacggagcgagactccgtctcaaaaaaaaaaaaaaaaaaaaaaaaaaaaaaaaaaatcagggcatgttcaaaggcagtttggaaattttcctctggcttctctattggttaattctgcctatgttggcttcgtcttgacacccttcttgttgcagaaagttacagctttctgtggttccaggagtccttccctgaagccctcctgagcctcgctctctccgaggcaggggcaccaggctgtaaaagcatttcacgggaaagcaggagctcacttgcaaggaatttggtgttgggtttcttaggaagtgtatcactcccacggaagaggtgacctggtgtgccgtttgtgcatcaagtatctaggcaggtaatgaaatatccaaatggctggaaatgcaacaaatttcctcgtgaacaatatttctggccttgttcaggtttctggctgatttttcggtttatatattttaaactcagtcttaaagatagatttgtgaagataacttgctgttttattgtttacctctggttgttaatttagtgactgagggaaaaatggggccattatggaacaaaaaggctctgcctaacacatatgtaataactctcatgcccagaatggatctgccttggagggaaatgctctgctgttactcctttagttcaaatatggagtagtcaccagggaagcttggagacccaggtgctagttttatcattgcctctgctatgaggttttatttattacttggcatagagtctagatatttgtttggacattaaatggcaatagaatattaatattgccttcctaatatctgcatttctttttatttccagtcaaaatgacatcatgtcacacaaccattaaaaaaaggaaattaaaaccccagaaatatgtgaaagcacggcagtgagtcgctgagctataaaagcagggaattctgtaagccaatgttggaatggcacccaaagcacttttcccctggtgtttctgaacagaactctgcagcctctcatttccatcgtttccaggaataagtattcaagaagttaacggggacggaggagtggcttctttaaaaggaaactccaaaaagagaaaaatcatttttcataactgagaatgcatctggcttgactatatgattttaatttgcaaatatacccccttacagagaatttcctttatttgatgtgtttgtgaagtggatttctttaagaaagaaaaagagactataggcatgaaaaggccacatatatatttggttagaattcactcattattatgagttttcaattgaattttagaagcttgtgattagtatgagtgcataaaaactagttgtgttatctcgattttctttgcatatagcatttcatgctgcatgcacatttggacattagagattatagctttgtagaaccagagctgttctgtcttgaccaccacctgggttgaagcccataaagagaaaggctgagagatcggttggaatagaaagttgctggtttcctttaggggactctgagatgatgagatccggaaggaacctaaagccctctataagcagtcccaacataaagccagaataaaacagtttgatttttttaaccatttcattaacttttttttcaaaagtagtaatgttgatacagttcaaatggcatcctggtgcatacaacagatacatcccaccaatatccattccccagtatcacatcatagctgtgggtgaggggatccttctcaaatctcagctgagacatttgccctgcaagcttactctcctgtttgggagcatttgattttgcttttcatgcatttacaggaacgtttcagatgtacccctccataagctgtacacaactccacgaagtcctactatgtgggttcagtaaatatctttctaccagtaaatgagtttgaaggggtcagtggaagacagcttgaattcaattgctgtggcccctcaacagcctgattgttctttaaattaatgtatccccattaagtgtattgtgaccctagactttgtcagaaagaggagcagaggaggtgactataaggaggacctggctgtgagatgctgagatgctgagctgcatcccagctctgcaagtagaggatttcatctgtctttgggggttggattatgtgtacctttcggaaagtttgttttaaagggcttatgatgttgtgacactaaacagttcattcctacgaatgccaccccctcttcttgagcatatggtaagcactaaaaatgattactgaataaatggataatttaatgtcttttggaatttttaaaatgcatacattggccccattttattctcatggtataaacattgaggcttttctatttgggataatggattcttctaaacctaactggtttagggtgacaccctctcagacccttttcagagtgtgtggactgggtatttggaagcagggccacacaagctgttctcatcattccattcctcttgcagtttacagcttcatctgtttttcttttttcaatctaagatgctcatgcttctttatttgtagttaattgtgtccaattaagtttttttttcttgctctaccagattctcggaattgtcccaagtttgagggggaaaaaaattggttagtcccatttcttctggtgcctcctgagccctgcgcttgggtacaatgaggtcactttgttgaaggattaactttatattacattcttgcagagtagatgtatgtccctaaggtatgactacccccactgatgaaataaatataccattctttatgattcctccctgttaccctctctgttgattttcagagagtttatgaatagtcacatatttatacaactggccaaaagtatactacttatttttcttatggtctgtaataacctatgcaaggttattaaagggtatacagacccctcttaaagcatagtttcttatgtcattactttatacaagcaggtcaaattccatctcagcaacaatctcttgctcttaacctttttctctgattatataagtaatatatgttcattgtggaaaatttagaaaattcacagcaaaaagaacaggaagaaaagcactttaagacccgctacttagaaataactactatttggcagtttatacacagacatattttctttattctatatatgtttgtttaaaaaaagtaactatattgtacacatgctcctgtaatctactttttaaccaagcaatatatcagtaaatattttttcctatggcattgcttttgaggatggcatcatattctattccatgcgggtgccttaaattaaccatcccccacttcccagatgtttaatatattttttgtgggggcagttaaaataacagtctttgtcagatggctcccccacagtcagtaattggtttactttttttctctagtcaatgcaatcagataaatcatcaggttcctttggatttaggacagtgagctttgtctagcatctttaatgttagctttgtctgcagcactggacgattccattgtaatattcaatacctgtattgagggcaggttaacttgtttaaagctatgaacagacagcaaatcataaaggcatgggacataagttaaaagcccttgccttactatttaaatatttcctctctcatagtacacgtccatggagtaaatccttatttttctttgaataatgagtttaatatgtctaattcaattactctgtggcagccgaatgacttctcttcagctctttagctattagttccatatgatatttgaattggttcttttaattgctgatattgtcggtcattcctctgtgagctggccatatagccggagaaacatctctctccccgccatacatcagacagtcattcaattaacaaccatgaatttctagacacaataggaattcattatgctaatgattgaagtggtggggcaacaattcaaattttactggtatcttagactgaaaagtaaaaccaagaattagaattttcaggatgctgaattatgttttcagatattaaaatgatgcatttaattgtctaaagctactatttatggttaaacatttttgttggcaattagcattatgggtgggggtggatattataaataacttaaaccttggtgctcattcctgtctctctcatgcatctcttgattaaatacagtggattttacaagttgcagcttccctgcctaaagaattctatggcattttctctacaagtctaatttgaaaaaagaattcttctcaagggtttagaaagtaattcataaaatggaaggaataataaatattgtgccttaactcatatactagtatagatagaaagatttgatacacctgggtgtaattttagttaatttccacaagagacaggttgaaagtttactgtttggaaatggggggagggttaactaaatctcatatttgcaaaaatgattacattatcttaaatgaaaatgccactctattaatgacttcaataagcattgcatttgggggaaaaaaatctttctaataaaaagttacctaaagttcactctaacttaaaatatacaagtgaagaaaaagtacttactctgatttatgtgtcttttggaggtgtaattattggctttttactcacctgtgtaaaacaatgtacttttgtaaatggatttctggccactttatgcagcttttttttttccttacataaaaagtaagcactgtcaatcaaggaattttaaggtttatttcctctttagaaatgattgatagccttttagatttacaagttgacaagttaaagagttctattggtataattatgtactaaattcacagtctttcaatttaaatgtccttttaaaaccacaagattatcatacctgtattttgaaaagtgggccagtcagtttgggttggtatacaaattgcttccattagccttgggacctatttgaatttaatacagttttttaaagttagtactagtatgaatcttacttttaaaatttaggttaatggaaatgcattttaagcaaaacgtgtggcaacttgttttttaatgtatagctaaatgtcagaactacacagactgtcttttttattcagcatgtgagaaaatacatggttgagcactttgattacactaaaaaagacaagaaattttaaaaaaacacccacctaccccttacttagagaatatagggatgtggaggctatggataggagctggagctgccgtgttttccatctccgctgtttcacgtgagacagcctgaagatatttcacataccagggagaaattttgaaaatgatagaccagagtccacttaatattgtgtttaatttaaggatgctttaaagagtgtgtagtcaatgtgcacacagcaaggtccattgtctccaaatgttattccaggtttgctcttcttttggtgttttcaaggattattcttggagactcggctgctctaagctagtacttcacagatgctggtcccaaataatatcaatgttggtgaaaggatctatcatttcagatgtgagagttttgaatcagggcattttcaatacccatccctttgcagactctctcaagggtggcactggctttccatacctcaaagattcacttctactcactctcctctactctcaccagcctcttgcatgcttatttgtgctgagatattgtatcagctgaggtccgctaaggattttgcagttaagcagatacttttaattctcctgctgtttacaatgtatagataccaccaggcaagcccttgagtgcttttacctgagcaactgaattaaagtggatactaaaaacctcacatcaaataccattttactttctatttatgatcatgtaaggagtgtagaatttggccaaaggaacactgttcaagacctactcctaatgttcttttgggcgggtcactccccaccgtggtataaagcagatggtggaaagtttagccaagagatcattcacacaaccatcttgtgatccaattcaaaagtatcagttaaactttggacttcctggttatttccacaccattagtgttgcaagccatgttcagctttatttcttgaaaatgtactaattgtgtgacttctttattgcagcgctcaacgaacccaccatcgattatggtttccagaggttacagaaggtcattcctcggcaccctggtgaccctgagcgtttgccaaaggtgaggatactgcctttttgtaattcctgaaaatttggacttgagcgatttgcagaaaactctgctgctgataaaaattagttcacaggtaaacaactcatatttttgtgttttgtgtgtttggtgctgtaaggtaagcaataataaaagtagcaagcacttatgtgccaggcaacactgtgcttacttttatatctgttatgccattttatcctctcaacaatgctctgatgttggtattattaccattcctattttagaagagaaaataagcaaggagagattaaataataatttgctcaaggtcacatagcatgtaaatcgctaaaccaagatttgaacctatgcagcatggccctagagtctgggctacttaatcgctacatcttaccaattctcaaaagaaaaagcagcaccaaatttctgtctacgaggatccgtacttagtcctggcaagaggagaatagttagagctcaaaatgttttggtagatcttgagattgggcaaagacaacctctcttctcctaaggcattctacctggttgggaaaataggcacaaatatgagagaaattaaacaaaaattcaagacagagtcatatatgtcaccaatacatcattaattgccagtgcagaaagaaggaaactgacctttattgactattgcatacctgttgtgaatgtttgggatatccccatccctgtacctgaggaacttgggctttatgtgggagagaatcccaaacacaactaatcataaaaataatagcacattaaagaaaagtgcaaccaacgttctgtgaggactcagaggagagggcagttaaatgcgaaggaagttcaaagtacagaattcgttgagcttgcattcactgtttactgacggcaaaaagcttcatttattacacaagtgaaaactattaacattaaattgaattagtagtttcaaggactctttcttgccacagtaagtctagagatatgccatttctaggtttatgtatccgtgtaaaacacttgcaaaaatgaagttgccatccttcttagcttggtgaacctccttggagtatcagttcgtcatcaaatcctacccgtgtgctggctgcccttgtaggcagggccacctgtcagaactggccctgtctgggagaaatccacccctcaggccactacacagaggtgaggcgcatggagaggaggagcgctaactgctccggagaggaaggactgtgatgagcaagggcctgtgtcctgcatcttgactttgagggaaaaacaccttcagttttcagagatgatgccttcagtttcaagcttcaatttccaagaacaacctcacttccactgaagtgctgtccttccctttccttttccaccccaatttattcttggtaagcaattaaatcatctacaggttatttaatattatttagtagattaaataatctaactataataataaacagcagtctccacccatggtatagatggtctgtggagagatttaccattaggttcctctgtctagcaagaacatggtcccgtgcatttcctatgggacaactggtaattttatagcacgatgatataaatgatgtgggtctgactaatggtaggtgccttagctgtcttcgtgctagaacaaaggcaggggtacaatgccagattcttcccattgttcccagtgaggaacatttgggcactgtattcactttatatttagcacttgctttaccatttgatctctagagtccactggaggtattgaggagagtcaggttggacaaagtggaattcagacattggccacttgctagctatgcaacctaggtcaaaattgtttacctctctgtgcctcaatgtcctcatccactaaatgtggatggtgctatgttgtaccttttcgagttttattacaatgacttatttagcagccaacaaaaggtagctatgatgatttgccagttgagtgagaatgggacccttgcttctgagagctcttccacccaatctctgcagagcaggaaatcctaatcctggtgagcagttgaacatgtgatttctcctctgtgcctcagtttcttcattgataaaatggggataattaatcatgctaactcataggggatcatgtaaggataaagaggtcatctcatgggtgcccttggcatagcatctggcccatagttgccactttaaaaatacttatcgagcagtggctcatgctggtaatcccagcaatttgggaagcagaggtgggagaattgcttaaggccaggaattggatactagcctgggtaccatcacaaaaccctatctctacaaactaaaaaaaacgttagctaggcatggtggtgtgtgcacgtagtccaagctacttgggaggctgaggtggaagggctgcttaagcctaggtggtcaaggctgcagtgagacatacctaccattgcactccagcctgggtgacagagccagaagaccctgtctcaaagaaaaatagaagacaaatctggtttaatggttgaggtctacggaaaccagacagttctttttcttataagaaaggaaaggagagaaatgggaatctagggttgagttttgtgtacttacttttgaaaacacttttatggttgcatgttatgttcagaaatgttgaacaaatagcataggcacgtgtcactttgtccctgatggtaaaattcccaacccttttttcctgggtttggaaagagtaatcaaggacacaatggatttgtgtgttaaggaaacactccacggcttgcatctagccacttgatcgtgcaagggctggccggagcccaccccaggaagctctcagtgtgactcagagccgagtggctgtcctcttggctttgaatgttaaagtggagcgagagttcaagggcagggtcaggaagtggcggatggagccagcacaaggtattcctgtggacttgggagatttatactcctgctgtccattgttagggagataaaaatgggctgcgcctttcttaggatcatggtcagtgtttgtcaaacaggagtgtttcagtgagctatggaccacacaccttaaaaaacaaactcctctttattaaacccatgtgtttgtgaatagacaaagctagattcatacaaccacccacacattctgtcaaatgaaactgctccaaagaccaagcagacagctttccataataatatgcctttgtatacaggcatgtgctttttcaaaaaaacttggacgtgctttgttttattggagtccctcctgcgagagaggctgggcagcagacatctttaccatttaccaaataggaaaacgggagcaagcggaatcctgctctgtaaattattttgtccctgaaagtcaccatcagtgatagttgctgtacacacaaatttaaaatactgtgattatgctaaccccagatgttttttggtttcctttttcatatacacagggagaaaagggcaggctaaggtttttaaatcacagcattctgttctgtttcatacagtttcgcctttctctctggatcctggcaggaaggggaggaacatgtgaccaactttgaggtcaaggttgacttttcttataatttagaggtggaggggatggggaacatggtcgatcagaaattctgagatgctgatggccgcagtgatgcaatccagacacattgggcaaggagcgctctctgtgttcaaggtcagaaatgtctccgcccccttgcagtttgttagttgccttcgtgagtggtcagtgagccttagccctaaggcagtgagtgagagtgagccctgagcttagctggcgtcaggcgtgtcagctgtgaatcctaggaagcaaggaatgtttacttcatgcctactgtgagcccagcactgcattattaaggttttcgaagatcatagaggccaagagagtgggctctcaagtcagaaggatgtgcgttttggaaacatgatcccctacttggtacacatgactcaacctcccatgcttcaggtttctcctctgtaaagcagctgcctcacggcattgttgtcaggtgttaatgagataatttatgccaagaggcatccctggcatctagcaagactccagtaaatgggggccactaatccctgcactgtgggtgttccccattttacagatgagaagttagagtccccagagatctgagtgacttgctacgacatcacagctagcacgcgggaaaactaccattcattcaaactcaggccctcagggtcggtagcctcactgccgtcactatgttgagttcccacttctcctgccttgaggtgtctcctctgcagacacctgacacctggcccccatccttatgtagattctcaccagctttctctcatttccctactgagaaggcttggcctggggaccttctcagggccaatgtcttttctccaagagccagcccctcttttagagaaaataaagcagtttgggaaaagtaacaaaggctgcatttgtgtattttgctttatggagctgaaaatatctggtaaattgatccagtgggagtaataaatacacattactttatcttgttcttcatgtcctatacccctgagccttgatagaacaccaccacttaatagacttaaaaaagagtaattacactcattggttgtgtgatttttcagccctcccagccctgcctgaccttctaatttagctcaccgtgtctaactaatgcatttatattcatcttttatgaagcatgtatagtacagaattgacttcagagcctttttcaagctgtcctcctaggtccccaatctggttagtagtaaggagaatgggagctatccatctctatgttggtaggtatagataacacgtagacatggctcaaagcattttttatcctttatgaaacataaaaaaagtatttattacatttttactttaaagcttttatacattcgagcattatttacagctaaacatgcaggcaaaagatgcgagtgtttttaaaatgattactgttaatgtttctgcttgtcagaagtgcttaaattttcctgcactttgtctaaaaacttagtactgttgccttttaagaacaacacatttaaaagatcttgcaagtcagatttgcaaacactgctgacagtttgtgatgaatgatattgcaaaatttgcaagatgtttgtcatttcacacagccgacatattaaggaacggattaagaaacgtgaaacccctatggaaaacaaccatcccaaacaaacctccgccaaaccttgaacccagagagcacaccggaatctctcacccgggttttctctcccaacttcccactcagccagtggaacccaattgttctcagtgcattttctctcaccatatggtctcctcattaccatacactaagagtccatatgggaaacttgtgaaatgaactgcattcattttaactgccagatgagcagccttttgctttgcaagcttagcttaagtcatctgctgtcttcatgttgttatggcaacacagcaccaataaaaaattctaatctactgtaagtgatcacagtattttaagtgcttgcctataactgccctcaaaggggaagagagaggagggttctatttgtccaaggagcaaaaagttgttgttcattccagcaggtgtcagtaaagaagtcagtgacatggggattgaagtaccagtgtggctggctgtgcagtaggttggaattataagggaggtgaacaccagtggggtggatggtgggaaggaggggttgtggacccttttggtgggtctccaaaagcacattgaatgtcaagcaccatagtatctctggcagacatgctactctggtggtgctgtgtggccagcctgccgtgaaggaactcaaggcttccttggaaatacagaggtagcaaatcctcacggtagcttctccttcactggcattcgaaaatctcagtctctatgaagtggctctccctgtacatgtgaattagtcatttcaaacaccaggctaattaagagtaccttaaagtaatggaagtaggcagcaacatccttaaatataaatcattttcacctctgctggccacatgatatgttgcatctctgtcgctctatctatattgaaagtgaatgtttatagtctcagttcatcagttcacattagcctcatgctgaatatttaaacacagaacaatttgaacacaccatgaaggaagacagtgactgcactttcatttggaacagcaagggctcatctaataataatttagtaaatcagccatttagtggctcagttgtgcactgcattgtgccaaatattattcacttcaactgtacacttgcaaaattgaaattcagactccagtcacaggcactgtttttgctcagtggagagacgagacctaaaatcaccctccctaaagagcattcatgtttagtgatttatcataaatacagagctggggcaaaataaaactggagttggctgtatacaatgtattctaattatgcttttattgttttagtctttatgcaaagactatcagtaattcaaaacctgcagttgcatcagtgaaaatacaaataagatatctttgcataaccacgttgcctcctagcagaaagggagatgactaagggtttcagcaaaggatgaagaacgacttaacatcttcatcttccacactgacactagcctctctctcactctcactatctctctttctctttctcgtgtatttacttttttaatttgaggaaactcgattaacattatatcctgaaatgaaagtgaccctcctcagacgaaaacacagaaacaaatggcaaatcttatggtatattcagctcttagaaaaaacatgcctgagtttgattccaggaaacatctctgcattctcttgtcaaaaacacaagctatggaatgctgtccatttcccccactctctcctgtatctaccagaaaacttacaggcagattccatttccccatttgataatatgctcagtctaggggcttggtatccactactacttatatttctttttatccagggagtttagcctggatctgtgtacccctgaaattgcatttagaattcctgtgtgtgtgtgcgtgcatgtgtgcgttatgaacatgcacacacaaatgcctgcacatgtaatttatctggggaaagaagttgtagcctcagtaaaaaggccgatgacccccatgaaagttgtaattctcacctctttaagttatttatctttagctgacttattttgcggcaaatgcttctgcttgtcattattgtttccttcccaatttagagatgaggaaactgagatttatacaggacaagtaaccttctcaagcttatgcagctagtaagtggaggtttcctaacttcccatacttcctaaccagtagtccatttagagtcttttatagagttttgaaaataggattatatctcaaacatagcactcaaggcacgcaatacacattgactgtaagaatgcatatattttgccagagttccttggaaaataaatggggattattaataatattgctggttattgcctgataagcactaactaaatataatctactaaaccaggtgttggtattaactctgttttacagatgaggacacagaggcatgtgtttacgctgctaatacatcgcagaacatggatttgagccaagtctattggactccagatccagagcctatatcccctaagcagtgcctcccagaattaagagattttaagaaaaaaagccaatttacaaaatcagtcttaaaacccttccagcctggttagggaaggaggcaagtggtggcctagacctgaggttagctcacaaagggctgagctaggtggaagcggcaggaagaattcacatgtaaatgcagacaaaccctgggtaccatgctttccctctttagctgcagagtcattgtgggagggacttgcagtaaccgttatccaatagctcagtgctggaactctttcgagttcctttttagcactgagttcttgatggggaggactaagggtaacttacttcatatcataccctgcatacaggggcattgaacataattactcattagttcaagggtaggtgacaggagaaccaagaggcaaactcatttctacctccagccacccaacatcctccccttaaagactgaagcccttaggaatggagatgcttggaggtcttaagccttgctcactattttcagccctgagtaacacttcagtggagcattagagtaataagtaccaagccccaacagtcttgaagcagtggattttaattgcagttatactcaggaccatctgtaaaggcttgagaattatcatttacagatatcgtttgtctggagatacatatgataaccgatgatgttcatgctcaacagttgaagaagcaaaagcaaattatatttttgcctcccttatgtatctatatagtatgggaacgtgtcactcaagtttccctatagtatacgtccaaaaatataaatatgcacgtgcatttgtatacacacacaccaaacatacaaacacatccacgtatgtgtacatgacaaatacatctctttgtttactgagcagtccctctacttttaagctcggtatttattcagccttggctgagggaaagaagccacagccaaaagacaaagagaaacagaagtagttaatttttggctttttgtgttttctaaaagcccaggccttggcgacttaaaggtgacttaaaagattttcaagggtaattttgactctaggccgtttttgtttcatgtgctgactttacaacctacccctgaaaaaggcatctctgtccagagctttctctttaagcagagacttttatcctgatcagaaagtcgatttccaaggcactcagcaggacctaacccacagcgttggtcttaaaccagtacaatgaattggaataagaagatcccgccagaggttaccaagttcagctctgtacctccaagcaggtcatagtcaacaagggtgcagacaccatttttcactgtatctgtggcgggaagcaccccaggctcccattcaccaattaccatgacaccatttagaagaaaatgccaggagaccaaataaaaaaaaaaaagggaggggaaagccattgtcataactcttctcagaaatacctggtttcacaatttatacttaactgctgacacttgaaaagtcgaacattttggtaaaatgaatcaagctgtaatgtttcttttatgagatccccttgcaggaaagggaagcttggcacctcatggagcccaagcttagttatccatcatagtaaagtcagctgtcctagccagcttctcagaggtcacacgatcgaaccaacagctcttacaactatattattgcttacgggacagtaattgaggcaccagataaaaattacctggtctaataggcagcgaacaattttcactcaataaaattatgagccaaatcatttatttcataacactctggctaatttatttgttgaccttttaatatccatagctcctcagtggtattaactgcaactcagacaaaatctcttgttcatttcactttcattgattttttttttccattgtggcaataacagttgcttgaaaacagcctttctttccattgtaaaagtcaatcacgtaagttagtatgtcttacgttgatatagccgcgttagcttacaacctagtttaatttcatatgattcagagtctcctataccatgtttttaacaaaggcaaggctttctggtttacctccaaccatgccgcatgctggttcataataatatgtttgagaagtaagagggctgtcatctaatctgaacataaaatcaactttaaaatcagaggaggttcagaagaggtcctcctgctgcattttctctagactagaatgtttttggtgccttggcctttggtattaatagcagtagactctttcaaaatatttaattcctttgttctggaaatgtctagagatttttactgtggtttgaatttcagtttttaaaaagactctgggcaaaaagtatgcgctagctagaatgttctgtagggcaatctaagcttcagctgaatcttcttatatactaaaatactatgaagtctttagaatgtggggttgtaaaatataattgttatacatttggcattttatgcctccctgcaaataactacttgctacctatacctcatttatgttcctcctttccatttcaatttactctaaagtggtccttagctataatgagaatgcccctttcaacagaaacatgtttaattatatccatgctaaatgtaagtgactcttctcagtcatagggcttctaaggaaagagtgtttaaagtgtgacactaaaggcttctaatgatctgcactaagctctatttcaagaagtttatattacaagaaaaatgaaaaatttgaggaatgtctcagaggatgggaaactaaacggtgcccaagtgttattttggtttgttttactctttccctcactgccctcattatactgattttttagaatgcaaagtctaccattgtggaattttccatttggctgaataaacacaaaggaagctgggatataaaactaccctccaaagaaatacatctcaggacaactagtatttattgcattgtacatccagctctgcaggaaatgggctgcaagaaacttccaatcaatttctcagcattcggcctttccaatcagtaatgtcacccaggctttcagaagtcagtggggaaagatccaggacttaaagtctaggagctgaatgcacacatcaaaatctgggtcctgcagtaaaccctatacgaaggaaggcagtgaaatcaatgctgatttcattgataggtgcttatcatctctacatcaagagtgattttctcatttcacttcattgtgtgttgctgatatttggccactatattttgaatcccctgataaagcaaagtagattggtgataaatgggtatcagggaaatgtgcagtgacagggaagtattgtgcttctttctcagaaatcacccaactcaacttgactttgattatggatgcttgtagttttttttttctgtttcaatctacattcctgaaaacatttcctatttgggtaagcataaagccaagcacagattatcctctgaaattactgaagcatccctgggctttaattttatgggcggagttcccagagtctcaaaatctaatgctgaaacatgaaaattaatgttgtgttcgtgtatgggtatctatcagctttatgatcatcagcctatatgtgctatgaacaaaagaaagttcagactatcttccctgctcatctggggttgagttgcccaaaacattgaactgggtttataaatgggcccagtattggccagttagacaacctttcccttcactctaggaggctagatgtggccagtgaacttgagcttattagctatagatttcaggtcaaaggctaaagagaaggactcccacagatggtgaataatcctaagatttttaactcataaaatagaagatgagttaactatgtctgcatatttgtcatgatatgcctggttcccaatgtgtctttctatgaatgtgcaaatacctaactatttccaagggcctaagagtacagctaataaaaggctgaggaccataaggaccaacctcatgttgctagcagcctataacttgagataatgtctgtactagacatgattcattgtattaatcacaaaattaaaatgtaagtccaagccagcaggaatgaaagagcaaattcataaaaaagtgacataaaaaaactcacagtgatcaaaacttgacctttgggaatttatatattggatttaagagtctgtagctaaatggaacaccaaatttaagtcttctacttttataaaccatgccaaatatgactttgtcatttcatcatacaaattaagtgtgtacttttaaaaatcagtaactgtatcttagaataacacatcaacatgaatttctcaagacttgtggtttgctaaacattatggtaggagcttagataaggagattaagaacctatcactggcctcaaaaagtctgcagtctagctatggagaatgatgactaacacacttcagatcagagcagaatgacctctcagtatatacttctgtgctgtgctgggtgacacagatggtcagcactctttttcagaggaaatagagatattaggagctggggtatcagtgaaggtggaattatttctgatagaacagtgtgattttcaagagccaggctctgatgtctaacaggcctggggttgaatccatgctcagccactagtcagcggtggaaactttgggaaagttagctgacctctctgagtgtcagtttcctcatctgccagatagtaatagaaagaataccttaagaggctttctatgaaggttgaatgagttcttgctccactttcaataaatgagagtgatctccttcattaccataccatcacgatccccttcagtacgaggcttcagaggatggagagaggcattgtccatgggcacagattgaagccagcattccctccaaaaaaaggggaaggcaaaaggagtgaaggtatggagatagaaaggagccaaatgttttacttctaggctggggaggacaagcatagagagcagttcttcaaatacatagggagagatgactggacaaagatggtaggaccaagtgatggcgacaatcttttgtgactctcatcaaactttgtaggtcgatgctgggaagataatgtgccctgaaagttgctggagaataagatccacatatgatgacagacaagggcaacaagaagctcaaacaatatttgctaattgggttgcaaagtagaaagtaaagctgaatcttccctttatatttgtagcccattcagcatttttattataaagcttccaaaatataagtaaaacccatgccagctacatttgaactgtttcttggaaccccattcctccttcggtctccctaacatttctgtagactctaaatagagtaagaataatgcatccacatttttctccatagaaccccactcacataaccatcaacctatggtcatagcaagacaggtgaagccacgttttgatagtgagatgaaatcaatcagtgaaaagtagttgttgtttttaaggagtaaagcttttttgtatctttaagagagaagaaatccaaggccatgagcagaaaaattgtctgactcagaatgtagattggagaacaaacattacctctacaaggagactctggggcttttcaatatttaggatactagtatttgtctttaattcccaaaagggatttttaaaaaaaaaaaatccaaggataggattaattatcttggaattgtctaatatccactcttatgtttgaaattgcaagcagggagacgttttaaacattatgaaaagaagagaaaatctcccctgacaaataaatgccttgaaacattagatattagtactagtcaagtgctctttcttttcagaaatattaaaattgcatattaaaatgaaagatccttagactgtgctcctgcctaatgccacaaaaaataagaatttaagaacaattttagagacaaaagattatatgaaacatccagctcttccccttatgggaaatttctttttttaacatccaaggctcaatcatttcctaatgtgaaattacagatttttcaaattaccatataaaactgcaaaaaaattacacttgtgaccacagaagagatggcatacactatcaatttgattttaaaaggcatacatcttttatactacctgtcatttttataatgccttttacaaatttaatcaatacattttaacattctatatactttaagtgcaatatacaataaatattcaagtttcatcttaaacatgctttagcctttaaattgttaaaactgcagtgccctttcaatctacttacataatgtcataaaatatacatttcaaggtaaatgaagtcagctacttcaatttagtccctcaaactggtagtaaatgagaggttaacactatggtgccaaacccattattgagtaaatttagcaccttggacagctctgtaaaatctttattgctttcctgacctgctcgtcatgttctgtctgtgtgttcagtggctctcagctctgattgaaaggcaatatattagatccccaacacaaacacgcctgggggctagttcactgggagcgtaatgacatggaggtgagagcaattttctggtcaccgaaatccaagcagtttgcaggtccattgcactaactcatggaggacccagaaatttcctttctccttcccatttgcagaaatacctaatagaagccaaatcacatgggcaaagctcaaccaagtctttcttaagtccttacaagttgatactacagtgaaggatattttttaatgggtaagatattatttaagggtgtccctttcaagacaagaaatccaggttcacactcctcaaatccaagactgctggcctgaagtgatgctgtactgatgacctacctatggcaatgtactcaatgggaaaacatgccccagcatggtggatcaaagaaggcagcatcatggatcaaagaaggatgctcctttaggaaacaagatccacgtgttttattctcaaaggattaaatggggatgagagctctggatatcgacataaggagaaaaaaaaaagtagattttgtcattgaaaaactctatcaccaaggatatataatatatactgatagatggtatgttttcaggcttatgaaaacttcaaagatcttggagtttaattttgaacttccctcctccctgcttctgtgaaattaattaaaataaggtacactgctctaagtcctcaattatagtgttacaagagtgaagttcacaagtgcagtttctttctgtgcctcatcacgcttttgacaaacgggagacttgcctttttcccccctaaaatggaaagaaaggaaaatacgttccctgccaagccccaacactggcataaatatttatttggagaaataaatgaacataggcctagagaagtctaatcttagtaaataaactcacttgatcctgttttttgttttcatctttcctaagagccagataaagccaagaggttttagtgaaggcaacacaggctgaatttgatctggggatagggtttagtgtgcccgtacaatagtaaattattaactgctgtggtcagacactactacagcaaacaaaaagtggtaaattagcttgtagcttacattaaaaaataaagaaatgatttcagatgtattggttcaaatccctttgattatataatgttctttactccctacatgaaaaataactaaactgttttataaagggggtctatcagcttaaggcaagcataaatgtttattgagaactgaaaaccccactatcttatttttgaatttaggacattagatatgtcataagtagttactgtagtatgacaactactttatcttatattatagagaatttaaaattgaaaaatgctaatatgtatctaaaagcttgtcatttcaagagttgttcaaggatttttgaagaggctatgatgacagcaaaatgaatgcgattatctccctattttctgatcagcgactgcagtctgtgaaaattgaacagcactgcttctccatgtagaaatctattgtgtaaaatatttaaagttacacttctgtttgaaactttacccacagtcaaaaatggtaaacatatcttcatgcaaatcacctctgatgatcctaccacacccttacgtttggttctctgacaagcccctaccttttacatgcatcaagcttaactttgcttttcttttcacattctagtggaaatgaatctgaagaaaattagggaaaaatgaagagagagatttcttttagttagaaccaaaaatattagcaccacactcactttgtagagtactccctattattagaaccaagcatgcaggctaaatatggaggtccacctaagtaaaaagagggagatatttttccttcaactggaatgagtagccaagcatctatctaggatgagaatgaatgagcaaatgggggaaatcacacaatactgaaatagcaaataattgctattaaagaaatagatactgccagtaatgaaaattggtgcagagggggcctctgaggacagtagagtcctttcataagagtttttgacaaacagtgcattgcctcagtatgtgggtttcctacatcaccctcttatattatgtctctaccatccaagagagataaacaaaagaagtttaatactacatgcttctagtagctgaagattgattggaaatccctcgaaaatgacctgtctgataaggtcatggttactggaataagcaattaagtgcaaaataaacacatcttagggattcataccacgactgaatgacatcaattgtagtaatctagtaaatgacctaggaattgtattcagcaataaacatatgagtgctttatcatgcctatggcagactattgagtgatgtattttatctcgcagtaccaatgatgctcaccttttgactcaattaagtgtgtatgtgaacagggataaattggtgatttaacacccttctggggttccccaagctacggcctttatagcagtgccttggcaaagtatggccagagggactggaatgtgatcatgtcaaaagataacgacaacctgccttcactcaaaggattgtatctgcttttctcttgacaggaagtaatactcaaaagggctgcggatctggtagaagcactgtatgggatgccacacaacaaccaggtgagcgctgtgggtgtctagcctgtgtggactgccacatgcaattaaagatctcagattcctcatcgtaatgagaaagcacaaacaatataaaagccatgtgcatgagttaagagtataagtaattcagatataacatgttgcaagatgattcaatcctcttttgtaaaccttttattgccctttccactgaatcattttctgtatgagaaaaggtactccatttaaaactaatctttagtgggaacatacttcctaattgaagaggagagttactggtgctttattttatttctctcaggttttcaagcaaatttaggaagagaaagagggtttaattttttctccaaaaagtatagcaaggcctgaatagtattgtctgcttctgtttcatagaactccatgtataagattcacatagcttaggaaactgagtctgacaaaccattcactcctttttcatgtagcctgagtcaatgtctgggggacacagtcccattaatactcagtaatgcaggtagtcatctacagccttcccttaacatcaataggggaggtgaattgcagcctctcttcctctccccctgggtaacctcagacttcctacatgttattgggaaggatggaaaaccccatggtgctgtcctgtatggactgtagggtagtatgaaggtatagttaagataatggactttcaaagtcagacaaatgggcttatgaatctcagctctgttcttaaataggtgagtgtacttcggtgaggtttttgactttctgagcctcagtttccccatttcggatacaggcatgatgatggtgagactaatataacaggtttgtcatgagggtcacagaagttaatgcagctgaccattgaaaaccctgagcacggtacctggcaccgaaaaaatggtattattgggaatatgactgggggcagctgaaggggatattcctttgacttttcaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtcagaagcttgcttttctcttccctccccaaccttaagcaccccatctcctcatttattggtcatgaacaatttttacattaaaaaattattttcatcccaaaagggagattcttagtttatgtgtataagatattattgtacaatattggtcctagctatcattcgggtaatctaatatagagggctagaaaggatgcatgcatttagccatctctctacatttgacttttcaccataaaccatgaatgacagatcacagagagggatggaattaaagttttgagggcccaaagcacatcattcttgcccagggaataggaacctgttaactccagggtacatctcttagatcgggatttatttctgctctaaaatgataatttataggcccagcattgccatttctcacggccctgctaagtatttatgatctcctaagaaatgtgtcttttgctcgcttcccattttaatcacagagctagcaccaccaacccacgcacatgaatcacccaatcccttccctctgggttgcggcgacggggccagaaacagagaccttcctttccccgagtcttccaggattgccaccatctgaatgccaccctcacctccggttttgcccccgcccctcaggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccagtaagtagagatgcatatcctgcgttcctgcacgtttcgctagaagaacttggcatcatgccatgtggcccagtgggcagggcttctcggtctgaggccccccatctttccctcctgtaaggcactcccctgggtgatggtgctaaaggcaccatcgtctccagcaggaatctccgctctccagtgctcaccttccttcctacaaagtctccctaacagtcagaatgttgctaccatccaaagcagctgtatgaagtcgcttcaggaacccatgctctgagttagatgaagacgggttgactcctgcttctcccagttactaactcccacttctaccagttaccaccagctactcaggaaactgaggcaggaggtttgcttgagcccaggagttcaaggttacagtgagccatgattgtgccactgcactccagtgcctgggtgacagagcaagactccgtctcaaagaaaaaaaaaaagcaaacaaaaaaacccccataaacaatgaggacaccatatttgtcatctacttaatcccaaaacatctattagtttcgtcttgtttcacctgattattttagctacataaaaggaatcaagttcatttcctctccaagcctcaattttctcatctgtaaaattgggaaggaactagcacccaccccatccagtgttgtgagacatagagaagatagcgcatacagtgagcttgtcctgatgccggacacatggatagaggcacatttagtaaatctaataatcatagtgatgcaaagataataacgtggtggtggtggtataacatagtaacaatagtctaaaacctaacttctctcccttcataattattcataaagcactcatgttgaaaaattccaatggaataaaaaaaaataagacattcctctggtgaacacacatatgactcctttattttttaatgcttggatttttcccctttgtttgtgtttggtgtatatttaaaacaacaacaaatcaaaacacttttccagaaatctggcaagattaaaaaaaaggaaaagaaaaccatatacacataaaaaaacgttctttggtgccttgtctctgccttaaagaagtttgcctacaaaaacattttggtacatttatattgcttctaaagaacctcagagaactggcctccttatctataaaatgtcataacccgtgttctcacaatctcttgatctcgctctgactttgaagttcatcttggacattgcgagtgactcttctgatgtgtaaaatgtggccaaactcttagatatttgtggaaggatagataggtgtaccattaaattaaagaatattcatgatttcttaaggagtcttggctaaaaatacagcaaatgatgccctgtctcatagtgaaagtatggattgttctagttctttgaaagaggaaagatcattcttgccctgtaagagaagttatttctgaaaatgtacttacagacttttactttctgggtgaatttttctgctcaaggtccacaaaattacacatttcatcttagtttggaatcagcagtttgttgaacatttacaactccccaaataatctgcatatattatgtctgtctactcacaagtcaatgtttaggatcagtttcacattagattttgatttatcaaaagattgtttctcatagagatctataatttcagtgttctcccatttattcagtcagaaaatgtttcgatcatgacctgaaaattaaaagatggcattcttaattaaatcaataaactaattgctatatggtagcaattcaatttaggggcttggaatgctctcctccccaagcctgtgcagacactcagccgcttcagcctgagattgcatctgtcagactgtgaaactttgaacatttaatttccattaattgattttctcagtgctcacaaacatagtattaaattctcaaatatgctctcagatgggacggctttatctgcacaaatgcaaataaaacaataaacacaaagcccagttgatttgaatttttgcctccataatatttaattattcataaagcactcatgttgaaaaattccaatggaataaaaaaataagacattccactggtgaacacactttctggtgtggtggctgataactaataatgttataacaaatggagctgcttgactatattttacctctacctctgttaactggccccccaccccaaaactccccacctctaaatacacataatgatcacatttgccaatgagattaattgccttcctcagtgaaccagcaggatttcaagtctacgaatatttaaaaatcaaacctccagtgcaggagttttgcaatttaaatgggtgttattattgagcgtattttcacagttacaaatcctaagagatgtataaaaatgctggcctcattaaaagaaaaagtacagtttagaaaatgtttgtgaaaactctgaggatggtggctctgcattctgccccataaagcactcagtgcgtgtggattgggtagtgccttggactgattagaaggggtcattttcccctgatggcaattgttgcctatgaccaattggattcccactttgcaaaggataaggccacccaaacagctcctttgactctggtgggctcatgggaacgaggcttttccccctggagatctgtttcctttgcagggtagcttagcagaaagagctccaaatttgggcgtgattccttgcttcagcgcattctagctatggcccttgggctagctgctacactactttctgagtcccagcttgcttcacttcctcggttgtaaaaaaaaaaaaatatatgtgataggccccgacttaaggttgcattgcccatgacaagatgaaaaagacgtgaagattcttgtgaatgataaaacaatatctgatgttttattaagttgtgtgaaaaaataataacatagaagaaatatctaggatacatactttcctgcaggaaatggaggaaatagaaagcgagtgtatgaaaatattagtcttgacttagcgtatgtgaaatctctgtctcctaaagtaaccgagagattattaacctggaacaaaagatgagaggccaggccaagaggatcatggtcggtagagaatgtacgtctaccgagctctttcatatccccaagctgctaggttttctctgagttgccagagttttcccatcattggttatctgcatccctactactaccaaactgtgagtatttatgtaaggctctgatcctactgcttattaattcccaaacattcatgtatatcccatggcggttataaagaatttggaacttgtagagttctgcatttttcacaaatgctgcatgtggcagtctggtggccatcctctcaagctggcttcttcctgttccccctaccccagcctctttcctagaactttagtttaggctctacctgggatgcatcccctgatacctcttctatgaagtcttctctgatttcccttccctgcctccactgagatggctatgttcacctttctcactgttttgtgctactctatccctcataagagggtgttgcacttttgtttcctggcctggaatactctgaggatggtggctctgtgttctgccccataaaggcactcggtgcatttggattggttagtgccttgggctgatgaccaggggtcattttcccttaatgacaattgctgctgatgaccctagtgcctagcacactgcctggcacacagtggccccacaataaacacataaaagatctccagtaatgaaaggtagcacgtgctaagttctgtatagtgaaagtggatgagagcctgcgaattcagggaaggtttgtgctggaagcatcgtctgagcagggcagagcaaggtggctgggtgagggatggatctgagcttctttgcttcaggatgccatgaaaggcactgatttctcctttctcattgcccctctcagtagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaaggtaagccccaggccccacctgccaatccagattcaatgccctgacttcaccctcccagggcctgaagcagatgcatcaccattgctgagggtatcagccttgggccctgcctgattctctctgccctcatctcttctgttcctttgtatttgctctcctcaaccctggcccttggcccttggccatactcatctctcctctgctggaggtgctcaagaagtcctctttccaacttcagcaattctgctcaggcccgggatttgcttgggaatactgtttctactgactaacagcatcatttctcttttctcctctttcactccttgtggtcgccattatcagatcagtcttttgtggactctagcaagttctccagtgcagggtctctcccgggactggccttctcctgaagtaggtcactcaaccttcccttcctgttgcctgtgtcagagtgaacgtgtgtgggactgataacagggagggggtgagccataacttgatcagagccctgaagttagatcatcatagaccaaaggccaaagacttcctactgggattaagaaaccccagaacaccactagagtattctgattcatattaaaattgttcaatcgctttcccaccattgcatttggaaaataaaatagttgctaagagttgagatgaccttttcattaagaataaaaggttacccaccttttaaaactgagcacaccatttcttacatttttcttatgagcttagcactctgttgtgtgtcatatgttgagacctgcacaacctcattcattgcccccagcaggattgtgtggtaggtactcatatctgctatttgacagatgagaaaactaaaggttagagaggttatgaaattgcctgacttttaacagctgatacatggcagaagctggcttcaaattcagactgaaacattcatctcctaaatactttattattcagaggtgctaaaagagacatagccagggttcctaaggcagctggtagggagataagattagtaaactagtcaaccaccatttattgagcactgaacagtgtacctggggctgtcctatgcatggagcagattttataccatttaatcctcacatcttcctaaagtatgagggccattatggtcttcattgtgcaaatgataaaatggaagcttaaagagggtaaatacctgaccacagacatagtcggttaaacggtggagatgaatgtaagccccatcagagtctgtgcccttaagcccagccatacaaagtttcccacagtgtcttcccttggtggctggcatctcactgatggaggtcagcctggaagtcagggaggggtgaggaaggcagtgcacatgtctgggatatctcagccctgtttcttatgtacaagtacatgcatatttctacttgtctacacatactgtgtgctggatgctttacactgtgatgagcatatagtgattctcctgaagaccgtatgatgtcagcactagtcccattatacagatgggaaacttgaggcttaatttgatccaggtcacatggctaataaatagtacagctaaactggaacacaagccatgtgaccccagagcctgagcacccgatcacgttgtctttctgcctccaggaggactcttcaaaatactcctcagaaccttgcttgcaaatctgcccagcacagcccagactcagcgccccacagagcacgccgctcttccccactctaacatacagtggcaaatccatcttcttagaggaaagaggaaaaaaaaaaaaaaagcgtgcctgtgcaactgcatttcaggcaatattactcatgatagaaaatgcccacctccacaaagtagagccacccattcctgcaaatctcattctctttcagctaaaaataatgctttgtcaccctcagtacacctccagctggcaaactagggatataatgcttgagcgaatataacttataataggtttaaataatgatcatacatatggaaagcagaaatttaccattcttgagctgccaatctcagcccttgctaaacatagatttgacatcagaaacaagatatgatggggtttataatcagcagttgacgggaagcactggagaagaaaaggcccccactattggaaggtcagtggctctatcataggccaacagtgacagaagtgggcagctcccaggaggcccgatgtcttctcatgccctgtggtcctaggaaggagcaggaagtggttggaaacaggggctgggctcagatcttatgacttcctgggtttcaggagatctggttatcaactgaaagccaggatctggatgagggtatgtgcctgtttaagtcatgatgaaatggcttcaggacagggatatatacaaagtttgtgcatttgtcctcccagggattttccaactcaattcttacccaattacagatcccaaaagtacagagactgtccccatttctctgaataactgctgagtctgtgcctctctgtcacctttcctaacacagggccacagtgtgggaggtttgaggtctgattcagggacacaccttgtgctggattcactgttgtggatgacactgccctttccttctgattgaacaaatgtcaaggagacttttttggattttcccctatcccatgccctgactattgagcatgataaaacaactataaaaagaatggactgggcgtggtggttcacacctgtagtctcagcactttgggaggctgaggcaggtggatcacctgaggtcaggtctttgagaccagcctggccaacatggtgaaacctcgtctctactaaaaatacaaaaattagccgggcctggtggtgcagcctgtagttctagctactaggatgactgagggaggagaatcacttgaacctgggagacaggttgcagtgagctgagatcgtgccactgcactccagagcaagactatttcaaaaagaaagacagaaagaaagaaaatggtttttggtttgctcgtactgtcatataccaaatatccctacttttgagatgtcagtgatggacatacggatggagaaattaaagtcaaattaatgtaaacatctcactttaagctcttctttctgcccactgcacccccaggtgctgtgctggcaggtggggcccacactctgggacttgcctctttagcctctgcacacaatctccagcagggcaaagaggacccagccttaggtgggcaccagtttttcagggcactcttgcttgagccacaaaagttttccctgagaaaggtgacattcagagaattacttcatctttaactttccaaactatttctaccataaaaaaaaaaaagaaaaaaaggatgaaggcaggttatggaattggtgtaaggatccctgaagtgttctattccacgtttttccttttcaatgttacagtagcacctacttcattgggacccacctagttcagaattgtgatcattaagacaggttaagtgactaggaagacttggttaagcaaattgcccatgtcaacaagattagaggtgccacatttaggccatttaagtgttttcaaggcctatttacctccaactaccactctgttaactgtgcatggttctgttttttaaagccgactcctaaaagacctcttccccagcagcactcccttagtctcctccggttactacacgcatatttattccccaagaactaagcacggccatgtcacatggtggtgataatggtgaacacagccactgactaggagggcttattcccagcctggctcccaaccacccttaaggtagcttgtctgttgtccctgttatacagatgcagaaactgagactgaagctaaggtggcttgtccccatttacacaactagcaaacaaggaagcctgggctttaagcccagacagattgactggactatgttaagcccctatgctatattacatttctatattcaagtcactaggttaggcacaagagggctacaaaatcctgccctcaaaatctttccctgtattaggggagacatgacaccaaagtaaataaggaagatctgtctgggaaaggctgggcacccagctgtggaagtacagaggaaggaaagatgaaggagaattcagaacaggctcaaggaggaacaagtgggattcagggccagggagatgggggcaaggggcactttcagcagaaagactgaggacaaccttagccaagaagcagagacagacatgtcctggataacatgcggtgaccagtaggattcacagattctatcatgattccagctggctttgtctcccaggtagataaaacgtttgaaaagttaccatatatctgagggttttttttttttttttttgaaaaagcaactctagtctcaacttctggagcctcacaaaatgtcctgttaaaaaataaaaatatggtagtcaaaaacatttagaatgtggtgctccctggatcactatcttggagatccacaattaaagtctctggggcatcctgcagttaaataaaaatgactatttcatttagtttggcaaacttgtttgcctacagagtccttttctgcatgttaagaacacttaatgtcatatgaaaaactttggaaaatgcaactatattttggatttaaagagaaaaatgcagagatacctctttctattcttatgcaggtgaagtaattgataaatcctggtcccagactacctaactgtgtctgttttccagagccaaagacttgagtcaccaactatgctcagtctttgtccatggagatgtcctctcctttctcctgaagcttatgctgcttagagcttgggtttcaggcaatttaggcctcagaggacttcatttattcaagacagaggcatccccaagaaggctgttacatgccattggaacccccgctgatgtagtgattctaaaccttagccatgtcctggacagtctacgcatgaaaaattaaaaacaaaaaggccagagtaatttcacaaaagtagtatccatatactgatgttttttcttttccaccttgctgaagctcaggctggctcttctcaaccctagatatcatgcagcccaggaccaaatcctatggaatcgtcattttttccatgcacatattcagtcggtgcaagatttacccactcacttacccccctgttcctgattagctcataattcctttttttttttttttttttttttttttttttgagaaggagtctccctctgtagcccaggctggagtgcagtggcgcgatctcggctcactgcaagctctgcctcccaggttcatgccattctcctgcctcagcctcctgagtgattagctcataattcttacacatgtggtggtttgggtacgaccacattccaccctctcactccaaaccctcccagctctgcagaactttgttttgtctttgtttttatcaaaaatatggaaacggtaatgaaaaatgcattgcctctcaaagcaatagttttctgagcttctgtcagagaacatgatcatccagctgctggggaaaatggcagagccaccatggtcttgtgatgtcttggcacatggtgctgagagggtggtgtcctcatgggaatctttatgcactccacttgggcaagttagcatgccaatggcattgctggaacattccaagctccagacacccatccctctcacccacataatcttcagattgcagcacagatataagaaaaacaactcctaaaactcaagatcttcaggcagttttgcagtggagtttctctattaaaagggcctctttggaggtatctaggctcagaggccacaggcagggatcttttcccataatttactcaaccgcaagggttctgcccttggagtttaggaagtcatgattgggatttagagaacagtaatgctttgatattacatgcaaaattctgggtgtaggcaacatgggccttagaatgttccagaaatgctgtggcatgctgtcttgcccaagtagggtacatgaagattccccatgaggatactcagcactgtgtgccaagacatcacaacctcttttgaagagaggttccatagctcccattagactctcagagaagtctgtcggctgatgaaggcgaggtaggaaagtaggagtgggccaaacccaccccctagacccatatatttgtttttaatttcaattttgtgctatcatgtataaacttggctatttctttttttaaaaaaacaaagtctaaatctctagcttctcttgaaacatttgagaagatcagtggctgtgagcaggcattcctgcccagtggcatttggtgggagctgagtcactgcccaggcatgcccttggcatcatcacctccatcctcacttacgcacccaggggattcactcactgctgttcgcagcctgggctcttgggatgctggagtttgcagccccaatggtccaaaataaaaagcgctgttaactatgaactggtacatcagttagctttgctttagaacttttaatgtggccctaagtggaggcttaatctagttgatctaacacactatttgggtaccaaaagcctgcttagatttttttttttttttaattctggccattcaaatgggatgttttcacagaccagctaataaatgttggctggacccaccaaccaaattagctttttcctttgctttgaatcatattgatactgcctgagttgtgtgactatactatagggaactgctctttaatgccaggcacgcagaatagattttggtggaaagcgaaagtagacttgcaccttttgccacaggcttaaaactcccgctgtctttaataaaggtgcctggacccacctccagcccagatgaaaagatccttggggaggcagagccatgctgggctgtcacacagcaaagactcccctgcgcctccttgcctttggagtgatagcatctcgaattctccagttaaggcttggattgaaatactgagctcctggtttcagtcaaacctagggctcacttgaatcttagggggactgcatttccaactgatctcaagtctttgggggtttaagttggtctgcgtttggcaaaagacaacttcctgtttctaagaaaaaaaggcttatgagggcttacagaaaggactccaggagcttttgggctgcaaaaaggctcttgcaaaacaacatttggatgatttacgtgtaaatgaatcagaaacatgtggattgaatttccttgtgaatacagatgggtttaaaaattaacggaaaaagtgtttggcaaaatactttttgggtttcattttaattgaatctaaaataccaggggtgggggtggggaagccggaggaacgtgggggtcttggggctaagagcccagggtggcctccctgtgtccacttgcaggatttgtggtactggggttcgcttttttttttttttttaaaggcacattcttccagaatagtaaactaagagggccacttcctagacacagtcatcactgacaagaacactaattaatttacgtttagatttgccataaaaagaaagcaatgactctctctgcctgacaagacacttaaccgtgattgggagccaaagacggctgccccttgcttgtaatgtcagcatctctctcactttgacatgtttcaaaggtgccaccctgttttaattttcttagttatccttttattcttcccagcaatcacacaaagtgtgccacatgggatggtgcctatttgacataagagcaaatacacctcagaaaagttaagcaattaacacaaggtcacacagctagtttagtagcagaagtgatgggttaaaaatcccagcagctaacctctatcaggtcctcactaggagctgaacccaggctaagcactttgcatgtgtcattttattcacctctccaataaccctaagtgttgctgtgattctagctacagaagctgagcttcacagcagaaaagccagaggtgggactcaggcctatctgattctgtgttctctaaataccactatctgcgacctcctagctttgaatgctttcaacaatttttggttacctcaaacaggcttcttttttcccaggatctcactccagcttccccaggctacagttttctaggaaatatggtcagatcattcccgaaacgttgagtgaagccgtgatatggaagacattctgcagtttcatgcaaacctgtcttctcctcccagctatgctttctcccaactttatgttcccagtgaacaaggcctgctgtagctggcatttccttctcccagcttaaggacctaagcaaaggcactcaagatttctgctctgtggcttagtttttgtgctaatacagaggatagggaatgccaagttttttgtagaaactgcttgcagtttggatggaccacttctttatattttgggtgtgaaggggagggaaaaaagagtgacaaagtgaaaattctcactattttgcaaggttcgaagctgcaactttcccagtggtattcaaactatgcaactttccagttatgccttaaaattgaaatcagatttggagagatgtttaggatattttgttctgttaaagacacatacccatgctgatttattataatttttaataaagcacatgtatattttataacgaaaattcattccagagaagatgagagcaaatttgtggctaatagtcgaacaacatagttgtgtgtgggtgtttttttttttttagtcttcattatttttctcagtgagaagtttgaacgcaaagaaaccattgacttctgtcttttctttcatagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaacaaagaaatcgaaaagcacaaaagaactgttttgttaccttaagacaatgtaactttttctagtagagcaagaaatcatttacaacaatgctgcaactgtgcatgcccccatatggattttgcaatggttttcactaggctgtcaagagtgcgatttttatgggttggggtgggtgggggaggggagttgtgggagggtaggggagggaggaaagctgtttttcatggtgagaaataataatgatgactaataataataaaaaaaactggaaaatgtaagcaaggtggacgcattgcttctcggtactcagaaaggttatctgaatttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaagatttcagtgttgggggaaaaaatacagcttctggatgactggattgcataacattgccctggcctcacattgtactaggatgcagcttaaatgaagtcatctctaaatctactaacctttcaccttcttatcaaaactttttgaatagacacacactgtacagttcaattgttagagaacctaactactgtagagattgttaaattttttttttttttttgcaaaaattcaagctgtaaaaacttttcaactttcacaatatttaattaaagttacttcctgtctgtgatggcagctcctagttgtgtattcatttctctatttcagatgagccaaagtccaacataatgtaaaaggtctgtgtttgcaatgactcagatcagtcttgatacccagtgaaaaggaattagggtagtgctgggacaccctctttcttatgtaggtccttggggatttgctaatctgggatgcaaattgaacacgcgcagcgtactgctgccctctgccggcggtagctggatgtgcacatgcccacaccggtccatataggagccaagagcccccagcaacttcaacagccaagccctgagatcctcctgcgtgattgaactgtgaatccaggaagtggccattctagaacccctatccttcgtgctacaaatctgaaccaagcttttcacacacagctgctaattaatcccagcgagccttctggtcaactaattatgtgccctggctcattgatgaggaggcatgtgtgaactgagccttctgttatcaatattttttaaccccacatgaataagatacttttcctgttggacaggagtgaaacattccacaaatactagataggtacctactcatgtaaaattgtttcactttaaattccatcatgatcatgagtctttctaaatgcacactcaatgattttcctacttttacagttattgaacatgatgaggttaatgatacttgtaaaatgcctcaaaaactcagcagataggctgtaggccaacggaaacttgatggccagaggtgataggatggctgcaacacagtcacatgtggtgggcactgtttcggctttggaatatagcccgatttgagtaatgaaagagagtgatatataagttagagaagctgccatccttttaaagaaacttgctgaaaagtgtggccattcaatatatgtttcttttgaattctgtgtttgatatagtttcctgtattagatgcagaagataaagattgaacaagaggccccttttctcaggatgcacaccatctcagaaaagacacacttatattcaaattatgctagaatggtcggccaggctgagacaggtgtgccacaatgctccacagagcacagctgacgtccacacctctgacacgctggcccctacagtctttaagggctacctcttgaaagtgctcattcactcgatcgttcatttattcattcatgcttgtaaactttgcgcgtttcctatgcctctggtgctaggcaagacatggtgatacatcggtgggccatggtgacattatacccacttggagctcatacttgagtggggcaaatgaacgttaagcagccactcaagtgcctgtaacaaacgaatcatggtaatgaagaaaatgtctacaatgctctgaaagtacattgcagcaggatctgatttaacctgaagtgctgggaaaggctccagagaaagtaacatttgagctgaggtataaaagctcagcaggagctaaccaggtgggcctggccccttaggcagaggaaatgagggaggtgtaagaacactgagctttggagcacataaggtacatttaggaacagaaaaactatgtgagtggagtgtgcagatgtgcacaatgagactgtggggcttgggagttcaattcagaacatgtcctgagcacctaccacgtgcctggtactgtgctagctgccaggtacactaagcaaatgggccatagttcctgcctgtagggcctatggcaaggctcataaactcacagccccatatttgttcataggggctatgctggttaaaaaatcggggtgggccaggcacggtggctcacgcctgtaatcccagcacttagggaggccgaggagggtggatcacgaggtcaggagattgagaccatcttggctaacatggtgaaaccttgtctctactaaaaataccaaaaaaaattagctgggcgtggtggtgggcgcctgtagtcccagctactggggaggctgaggcaggagaatggcgtgaaccggcaggtggagcttgcagtgagccgagattgtgccactgcattccagcctgggtgacagagcgagactccatctcaagaaaaacaaaaaatgagggggtaaactagggataaaaacaaccagacagggagtgggagggctggggccactggcaagtgcatgctctgtccaaagtgagaatcccacttgctccaggcaattgctcccatgtgagaatgtggacccagtgttgcccatctttcatttctcaagaatgccagatatgttactagattatttaaaaatctggcataaaattttcatttttaaaatgtcagcaacttatctaaaaacagtgttttaaaaacactttcttggccaaactaagtccagaatcccctagagtgtcagtttgagacttctgaccaaaagataagttacgaacggtgatgttcacacagcctgatttgaaagtcataatgacatgttctctccatggagatcaaggaagactgcaaagaagaggatactccagtggtgttctataggataagagttctccaaacatataagggaaagtaggtaatggaaggcactggtcaatgccctggcagctgactttatgagaaaaaacattattaccataaatccaaataggaatatggaaaattggaatcatgtgcttgtgaaaaaaaaatcctctgtcttctgcagtagctgtattcaatgcagaagtataggtcagcttttaaaaacaacaacaacaacaacaattctgtttgccttgcagaaagacccttatgaatgaatccatttttaagtacactttcagtgaagtggaccctttccaacacaccatgctcaaagccacacctgccctagcatgctccaaaatcatcatatcatcaagaattttgctcctgagattatcttctccctctccagcaccatcacattctctttcctcaatttacattcagaccagcttacaaatgtgatctcattgaggaaaaaaaagatttgacctcactttgcttgtaagctagccacagtcctcctgctcctgatagtagcgaatctcaaaagagttgtctatgtctgctatcttctcttcttcatttatactttctcattattcatattacaatatatgtttattgtaattttgaagagtggagagtcttccatgttgtaaacaagggatctcaatttatattttagaagtaccatcttggttgctacaaaaagaacaaattggagggagacagagggaaaatagaggacattagaaggccattgcagtcatccaagcaaggaatgaacagcttggactaggagaagaaaaaggaggaaaatagagaggattaaaaaatatttaggcaatagaactatcaggatttggtgactgattcaatgtcgggattgagggagatgaaaaagtcaagataaagctcagttttgtgactgctggtaaagaaatagttgatgtctctgtttgggctgtttccttgctctggagcgcaataaagaagccccttcctcgaattgcctttgctttccttccctcttccaaatatgatcctcttctccagaggcttctgtatttacattaggaatgaaattcagtttctggagctggaaacactttgttacttttttttttttttaacttaagcatcaagcagttttatctcttctctctggagagttatgctacagtgggactgatttttatctacttagcatacatttttcccactgattgtagaattttcacattctatattaagaacaaacattctaggccctggcgttaaccacaggcctgatggttggccttctgtaggaaatatcctgcactgggaattatcttataaggaaaatttagtactccacaaagacgctgatgaaatgtcaacacaaaggaaggagagccattgagggcgattcattcaataacattgatatggatgggattctgccaggaaagcaaggagaaatgaatgagaaacaggcattacccatggccttctctgaagcatttatttacacaatatctccttactgaacatctttgtgtcaagtgctgtgctaagggctgggaatatgatttatgtcttaaatagacctatctccttcattgtttactgcctaaggaggacagagacatgactcaaacaatcacacaaacatataattacatactgtgataaactgctctgtaaccctaatatatctgagtgagcatgtggctctatctctgcataaagttgagcctagctcaacagccaaaattaattaaaggggaaccaaattccttatctagacccatcaaaagctattaaaataatctaaatataaagcccacagcaatatctagtaaagtgacctttcttctattatcttttccctcacttctcatcttattcagatactactttctccaatccatctgaccaaaaccccctgctctattctaagtttccatgatttttctttctgccttctccctctttgtccatctctcttattgttttattttttactgtaggggcagagaaggtttctcttccaccctctctgaaggttctttgaaatgactcaccatagacagataaataggagaaaaaggcatacaaacttatttacttgcacaaggaccctggagccctgcaaatatgagactcaaagaagggccagatggctatagcttaaataccctcttcataggggagagggaaacgaaggactataggtaatcttacaaggatagtacatattttttagggaaaatgaatagactggggaggcagacattatcttgtaactgactgtcttataaaactgcaatttataggaatgtgaggggcaaaactgcattgtgaacaaaggttgtcttactgtgcagataaggtcttccaggtaatctctctgagctgctctcagaagaggagataaaggtctgcctgaacatggtgatgacttttagcctcttctctgtttgttaatctttcctggttatttgatgagattcctagggaggtgggtcttaagacaattgcatttctttcagaaagaagtttccttagtcagataagaaaattcgagagaaaatctctccctgtgcttttaggggatgtggggtgggagggtaacaaatagataaggttagtaagttttggcttctgaggcagcttctaaggccttccaagttttaaaaattctgctcagcatgccaaagcaccatactttgggggatcgctctctatgctccaacattagcaagtctcttttccagcaagaacatctttcgtctttagcagagcaggggaaaaaagggagatatggtgctggttaactatgattccttttggcaggctgtgggagggaaagtccataaacattcccttgttgatactcaagaggcagaggcgggaggatcacttgagcccaggagtttgaggctgcagtgagctatgatcatgccactgcactccagcctgggccactgcactccagcctgggcaacaggttgcactccagcctgggcaacattctgtttaggcaacagaatgagatcctatttctaaaaataaataatactaataatcccggatctgttctactttgagaggcaagcatagggaaccatgagcacatatagcaaataaattgatttggttatgtttgagagaagacctggagaaggtgaagcaagtcagaaaggaagagttgggagtgaagaggaaaaatattccagatagagacgacaggttatggagcagtggaagaacagaaagaaggctagagggttggtaccatctattttcccctggggaattcttctcctcagttcatctccttcttccttttctcatttcttttttctgcttttaatcatgacttccttcacctttgtctctgcatcagtgctgaagagtattacgctcactggtagctcttaaagaagagccagcatcctagattttccaatgcccctctccttccatttctcctcatgcctacctgacccctaaatctattgcatggaattttagagacatagtcaacttctcttcaaccctttagacagccataatcagaggaaaggttgggcctcccaatgtgcttctttagaattcaaaggaaaacattcctaccccccaatcacatgccctacaaaccactgcagctcaaagtgcccaactgaaaagagcaacgagcctcctattcttcacaagcacagaatattatagaacatttttgtgtccagtacaatgccaatttactttatcaaacttaaggagcccagaagaagagagtaaagataagcaggaaatcaatactaatggcaattggcatcccttgttgagggcttacttttatgtattattattcacgttaatttattttattttctgagacagggtcttactctgtctcccaggctgaggtggcaatgatacaatcatgtctcacttcagcctcaacctctcaggctcaatcaatcctcccaccttagctccccaagtagctgggattgcaggcgtgcaccacacatctgggcaattatttttttaatttttgtggagacggagtctcactatattgccaggctagtctcaaactcctgggctcaagtgatcttcccacctcagcttcccaaagtgctgggattacaggcatgagccaccacaccctgctgggggcctacttttagatgagctgatatactattagctatagaaacatgtttgttaacttctcacagtagccatgtgatatgggagcaattatctcctgctgaaatagaattgctcaccaatcccgtataagaacaaaggatccccaatggaacttgaaggccatttatttaatgcctataaacacagtagttagtatatctacggaatgcattgcttcaataattcgtatctatggaaatgacttaaatcactcaaattctataactctcagttactcatcttattgttttaagtgacaataagagtatttatgttaaaaggtgtctaagaagatgatgttaaataagtcacatatggagtgattcagtgcccaggacatattagccactctgtcaatatcagatattgttattccgttccacaattccaagttgtgtgtgtgtgtatcataatacatttaactgatctcaaaccaatagacattaggttgtctcttatttcttgatactgcactcattatgatggactccttgatttaaaagaataaaactcttgcaaattcttactgcttcttgaaagctaactgtatagtatccctagcattcacagtgccaccctgaagattagattagactcctttaatatgggagacttgcccaatagtttccatatggatccaaaagatggtctgtggctgatgcttgtcataagcacaagcaaaacaacagttctccttcaaatcatttattttcattatatttctatactatatagtaccagggaaggtaccagggaactccagacaaaaaataaaataaaataatcagtctgaatattgtcatgtgctgaaggaagcagattctaggcaataaatctgcagggcaaaggcttagcactgctgtcagggaagaggataaagatgagaggtgggtaatgtaggggcacagggaaggagaaaaaaagaaatatttcctatgcaccaacatcacttagtagtaagatcctactaagccccttcagagttaaaaaatacaaatgtaacaggtttcagagaaatgagattaggtgtaatttagatatgatgaattcatttacaagttggactgctaggagtccccattttcattcagaatgagaaatctcatgaaataacttacttacccagatagttaggtggttactatctgccagttgctgacctagaagctggtgtgagagccattggatgtagacaataacccagtataaaaccaaaagcaaattagtaagttcacatgtaattacacattgggaagagtcctgtgagagaaactggcaagatattggacacttcatcttactgatgctgggattggccatgggcttgctacagcctgggggaataggtggtaagatactgacaaaggtcttagatgcgactgtgaagtctgtcctggttctttttttttttttttgagacggagtctcgctctgtcgcccaggccggactgcggactgcagtggcgcaatctcggctcactgcaagctccgcttcccgggttcacgccattctcctgcctcaagcctcccgagtagctgggactacaggcgcccgccacagcgcccggctaattttttgtatttttagtagaggcggggtttcaccttgttagccaggatggtctcgatctcctgacgtcatgatccacccgcctcggcctcccaaagtgctgggattacaggcgttgtcctggttcttacactgcagagattggccacgagaagggcttccccatggaagctgttgaaactccaacctgagttctgaaatgtccacacctaaaacaggtatgagcacagtgacatcctggagctaatctctgctgcccctcaactgggagcaatcacccagccatgcctgcaatatcagccgttcctcagacctactgccctgcaaatttgcaagcttgagaattaacacttactgttaattcttgaccttcga

SEQ ID NO: 17 - DNA, 42741 bp, Homo sapiens
catgattatcatctttaccatcatcagtgacatttattgaatgctcactatgtgccaggtaccacgtaaacactcgatatatgttatcttgttttgaattcacataacaaccctctaaagtaggtatttttataccaactttttaaagaatggattcagggattgtggcaaacagactgtaccataaccctcaatgtttctaccttctgctgttcacacatttgtgtaatcccctctcctgagtgtaggtgggacctgtcacttgactctaagagaatatggcaaacgtgatgagatgtcacttccataattatttcacgcaatgcaagacaactccatttcagcatactggagtcagaaactctcttgaggtaggaaagcagccatattagaggttcatgtggcaaggatccttgctcatgtggcaaggatcatgggaacctcagggcagctaaaactgacaacaaggcacaggcttcagacatacgttcagtcacatgacctcaaggaactgaagtctgccaacaatccacaggagtctggaagcagattcttgcccagtcaagctttcagatggacacaaccctggccgacaccttgattgcaggcttgtgagaccctgaacagaggatccagctaagctgatcctgactgttgaagctacaagataataaatgtgtgattataagacaccagctatgtggtaactggttatgcagcaatagaaaactaatacaggaaggtgaagtttctagccctagatcccacacgactctgggactagatatccatcccaggtctgttcgcctcaaagcccatgttcaacagggcatccatgccctgccctcttgctcccagatggtactttcaagatggttctaggtatgagcctgcatcctaaaacatgactcagctgaattcctgtcatcaactcaaatcaaaggatcttccctcacctgtatcacctagcagattccactatcttttcatatatattgagctacctgatagaggaacaataatacgggttcaccgtgggcactatcggagaagttttagtaacctgtggtcctggtaggacctccttgaagatatggggcttccatacatgttcacagcaccccactgtggggttggatgtgtgactgcttagttagttactcagtgaactggatggcagccagcaaattgtagcacttggctttaaatgatttgctgctcgacagcaccagcataacacctaccagtgtcctattaaccaggatggacgataatctcaagctcccagaattctcagagaataacaatttatgataaataactatggcatttagatatggtgctgtgcccttccatttttttttttgagaaggagtcccgccttgccacccaggccggagtgcagtggcgcaatctcggctcactgcaagctccacctcccaggttcacgccattctcctgcctcagcctcccaagtagctgggactataggcacatgccatcacacccggctaatttttttttgtattttaagtagagacggggtttcaccatgttagccaggacggtctcgatctcctgacctcatgaactgcccacctcggcctcccaaagtgccaggattacaggctgagccaccgcacctggcctgtgcccttctattattctcttgtgaaagcatttgtaaactacatgaatcaattgactattacactaaaggcagaatgcatttaagagatgaatgaaaatatccctcatacatcgtggagacataaagctatagtagttcacccatccaacattacatcagtaaccagaattttaaaattttctcttgtaataagctgtcataaaaatattttccttatatcaatatatcctcctaaatggtagactgaaaaatcaataagccaggatgcaaaaagaaaagggaaataaatatgtgttatatatttgtcattactctcatcacagagggaagcatttaaagaagcaaatgttattaaaatagtgacattaaataagtacctgttttatggcttgtctgtttatacattcatttgttaattcaactcaggttgatcatatatctatcaagttcaaaggcttactatgtacctgggaagaatacaaaaaaaatagacatacagtctttgcttcctgaggctttcaactatatgcatctaacaataaccatttggactaatttaagcacagagagccactgagacatacctatccatttttgcacatatattttatcagtacacataggcatagaaaaaagcccagagggatgtatatcacaatgtaaaccattgttacctgtgggtggtgagattacatgtaatgaaaaaaaaattgtatttcttaaacaaatagaaattgcccataaaaataaaaataatcatgtatagctattaaagattgttaaggctcggaacactatactccaaagcatgacactttggcatgctgagtactttgaactgtaaaagatgggaaggacctcggaagcaagaagttccctttggccttctccacactcctttctccttctcccgttttcctcccaagcaggtcatgggaatgaggatccctcttctccaaagcgggtcatagaaactagaacccctctctcccgaagcaagccgtaaaacctcgagaggtcattctctgacctacctcctctgaaaataggccataagaccctcattccagaagggtcttgccccacacccagcagggaaaaaatcccgtatgaagaggccaagaagaatccgaacaaacaggccttgctggggtccgctgtttattaccgttagagcataacctttttgtccaatcacatttctacatggctgtccattcttcattgaacctaagcataaaaatgcaattttccctgggtctttgggccttcatttctgaaggctccagtgtcacatgaaacttgattgagtttgttatgcttttctcttgctaacctgtatttcctatagaaatgttggctgtggacctcaaaatgagtgaggaaaaggtattacacctttttgctccaagatcttttaaaccattaggtctgacattaattaaacaggtctaccaaatccaccaaaacaatgatgcaaatttttctttgagcaaagaaccaactaagggaaaataaagaatatttagtccactttcttcttattattataagttatggggtacatgtgcagaacttccaggtttattacataggtatacacgtgccatggtggtttgctgcacccatcaacctgacatctacattaggtatttctcctaatgctatccctcccctagcctttcaccctctgacaggccccagtgtgtgatgttcccctccctgtgtctatgtgtccacatataccctcccaagactaaacaaggaagaagtcaaatccctagacaggccaataacaagttctgaaattgaggcagtaattaatagcctaccaagcaaaaaagttcaggaccagatggattcacacccaaattctaccagaggtacaaagaggaggtggtaccgttccttctgaaactattccaaactatagaaaaagagggaatcctccctaacttattttatgaggccagcatcaccctgataccaaaacctggcagaaacacaccaaaaaaagaaaatttcaggccagtatccctgatgaacgtcgatgtgaaaatcctcaataaaatactggcaaaccgaatccagcagcacatcaaaaagcttatccaccatgatcaagtcggcttcatccctgggatgcaaggcaggttcaacatatgcaaatcaataaacgtaatccatcacataaacagaaccaaggacaaaaacacgtgattatctcaatagatgcagaaaaggccttcgacaaaattcaacaacccttcatgctgaaaactctcaacaaactaggtattgatggaatgtatctcaaaataataagagctatttatgacaaacccacagcccatatcatactgaatgggaaaaaactggaggcattccatttgaaatctggcacaagacaaggatgccctctctcaccactcctattcaacatagtattggaagttctggcccgggaaatcaggcaagagaaagaaatagagggtattcaaataggaagagaggaagtcaaattgtttctgttttcagataatatgactgtctatttagaaaaccccatcttctcagtccaaaatctccttaagctgataagcaacttcagcaaagtctcaggatacaaaatcaatgtgcaaaaatcacaagcattcctatacaccaataatagtcaaacagagagccaaatcatgagtgaactcccattcacaattgctacaaagagaataaaatacctaggaatacaacttacaagggatgtgaaggacctcttcaaggagaactacaaaccactgctcaaggaaataagagaggacacaaacaaatggaaaaacattccatgctcatggataggaagaatcagtctcatgaaaatggccatactgcccaaagtaatttatagattcaatgctacccccatcaagctacgattgactttcttcacagaattagaaaaaactactttaaatttcatatgaaatcaaaaaagagcctgcatagccaagacaatcctaagcaaaaagaacaaaactggatgcatcacgctacctgacttcaaactatactacaaggctacagtaaccaaaacagcatggtactggtaccaaaacagatatacagactaccatcagagaatactagaaacacctctatgtaaataaactagaaaatctagaagaaatagataaatttctggacacgtacacccttccaagtctaaaccaggaagtagtccacattcttttaaaaaaaacatgtcttcttaaaattaagcattatctgcaatagtgcttaagagctccttcattattttcccctcaggggatgtttaggcttatatttttgcttttgttttttgctctgactaaaatttcaaaagctttatagcagtatgtgtcctgaaagatcagattgcaacaaagcacctttgaatcagtttgcaagatgagccacaggaatgctggagggaggggttcggggcatcaggagctggaggaaacttctggcagcagaatttaaccacgaacagagtacacgctgcagcccccattaggtactgggggagaaataacgagtgaaattgtacaaatgcaaaatgctctgtaaatgactatttcttggttgtccatgtgtgaaatagctagaaggggatgttcttactggaacactctggagaggagaaatggaagggggcctttgatctatcttcctatgtgtgcagacctctgctgtgcccctgctggcataggccatgcatgcccaagctggacacttaatcctgggtctagcctctgggcagaagggttgggtggaatcacagggggctttttcactgtgggcataggtgggtgagaaatatttgtcatatgctgactttgatatattgagttctctattcttcaaatcacatcacttacccagtggtaaagctggaagggctaagtttgtggtgcacacagtcttgcagctgcatgctcccatagggcaggggtcatatctgtcttctttaccatggaagatgtggcacctcacacgtggcctggtatagcacaggggctcaataggtagctggaagatgatgctacaagggagtgaagaaatgcataccttctcctggtcacattgaacatctctcatctcctaatgagtcttgtcctttctacttttgcccttcgataacccattctcacacaagaaccggaatgatccttttaaaaataaatcaggttctaaaattagcttacagtgatggttgtacagctctctaaatacactaaaaaccattgaactgcacacttcaaatgggtaaatttgtgatatgtaaattctatctcaataaggctgttaaaaaaaattagattgtcattctatgcttaacacccttcactggttcctgacatttcacgtagaattcgccagactgcttatggtgatgtacaacatcctacctttcccacgggctctgcctgcctctccaacctcacctcacaccaggccacagcttacctcccactcttacctgaatctgcctaccttggtcctgccttccacaatattcttctccatacttttgtactttttttcatttcttccttttatttgccccttaagatttccacatcctctctctgcacattccaaatggtggctttcattcagatctcagctcaaattccatcttcccaccttaggtcatgtaatgtgaatcaccatcattttctctcatattattatatttttataggacctctatttgaaattatcttgtttcttcattgtttccctcactcaaatataagctctgtgagggtagaaaaatcttgtgtttaacccttgaagaacagtgcctcagatatagtaggaactaataaatatacattaaatgttgactgcctgcttcctgcatggtttattctgccaaacttgtcagaaaaaacaaacaaacaaacaaaacccatgaatgtttacaccttagcatatctttacaagaaaaaaagttttaaaactcattgcttttgaatgacttttcatttttacatggcatggcaaaataagcaagcttctatctgggaacaattgatttccaaagttagaagattaaaatcatgtaaatatttcactataaaaaaggtattataatgctgttaaggttcagtcatagtcactttaaggttgggggtggagggagagggacagctggacttccagtccaaaccaatactaaatggaatttgcagacgtaaaagcagctggatacttaccaaaagatctaggtcttcagaggtttccttattctcctttccttgattatttagaaatcttaggaaaaccaagatagtatttgtaaaattatcaagaaaagtcttccttttaagatttcacttttggtaactatatttcaggaatgatagggctcgatgatagcaacatgctctgtgctacttttaacatctgacattcatataagcctttgctgcttccaagtccttccatgggaactgtctcatttgactttgccacagcctatgggaaaggcagacaggtgcagaatttttttaagtagaaggaagcaaaagttaaatgagttgaagtgacttgcccaaggtcctgttgccaataaagagggattttagtcacatgtttttctgacaaaccactggctctttcaaaagccttatttaggaagctacagcagttctcctcacagattatccaacaagaagtaatagcaatcagtgctccagagaattaagaactgggaataaaagtaagagggatttgtattcaattaaataattgatttacctctagattcctgaaaagtcatcagtttggcctttagtgtaacaaattatacacatacactaatgtgtgttcatcatagccatattggtttatggaaacatcattaaagcttagcagtctttgtttttgatatttttaaggttttgtttctactgtttacaaatgttcttaaaagctgtaagttcagcttttaaagctttttggaagcaaaccagcattttaatgagtaacagttcatatcaggaaatatccttatgtttgcatttaagtgcttgcttacttccaaagtgtttttacgaaattattaatgtgggaggtgtgcaagattttaaacactttacatggaagctcattgacattactagataactgacaccatttttagccctacaggatgcttcgtattgatttcagttcttataaggcactaatttctcagaagtctttgctaaatctatgaaactgattacaaaaagattctcttaagatttaaacactaagcactctgaagagatgcctgcaatcccaggatcactgcagcattatttacaatagccaagatatagaaaaaaacaaagtacttatcaagggatgaatggatttttaaaatatggtgtatatatatatgaatactattcagccttaaaaaactcaggaaattctgtcatttgtgacatgaatgaagctaaaggacattatgctaaatgaaataagccaggtacagagagacacaatactatctcacttatacgtagaaatctaaaaagtcaaactcacagaagcagagagtaaaagcggttaccagaggttggggagggcggtggtggtggatggggaaagatgagatgttggtcaaagagtacaaagtttcagtttaataagaggaatacattctggtgatctattgcacagcatagtgactacagttaataataacgtatacttcaaaacagctaaaaaagaggatttaaaatgttttcactaccaggaaatgataaatatttgaggtgaatatgctaattagcctgattcaatcattccacattggatatatgtatcaaaacactatattgtaccccataaacaactgtcaattaaaaatttaaaatattcagatgtctcaccaagactcacgtagcaaaactaaatctttacataaatatctaagcatttaatcttcacagacatttcttgggctagttcataagaagattgaattttgatgtaaaatacttcattggagaccataacagttcgtcccttgagagagctctgttgagtacttgggatgagaaaactcaaccgtttattattcatgttttattaccattctgaccacccaattgttattaatacctaaaaaccaagcaataacctaaaatgcaactaatctgcgtttttttgcatatccttttttcccagtccctatcctgtagttcctcttcctctcaaggaactattttactttccatgaataaaaaataagtttcagttgcttactgtaacaacctgtttttccattccttaccttttacactgaagagctgctataggtatcattagtccaataactgatttcggtaacaaagacctgaggggaaattagaaacttccctctgaatcaaagatttactgatgttctgtagtttttaggctaaatatacttcgtataatactgttttaatgcttaacacatgtatctgataaaaataatttgtggtttcaccaaaatatgcatccaaattaagtgatctattgattcaattgtgtgtgccacacacatagatatatagagatggagctgttcaataagccatgagatgcagaagacaaatgaaaactcccacactctataatggtattaatcacatatagcacgttatctcaacaagctcaatgacaatgttctccggagtggcttaattaagcacagcagctaagaagctttggtttgggcaccacctaatggcagaatatgtttttgtaaaattctactttgctccctgtgatttgctaacttttgtattttagtttatactgatttcgaaaatgtctgcccgttcttgacctatgttaatagtttaagtgttccattttcttgagaagattaagccctttccgtgcgtactttggaataagttgtcttttacagtgggaaaaatgtaccaatgaaaaatgaatactctaaaatttctgttctatccttaaatatttaaattttacttcataattaagaaatatattttaattgaatcactttagagtcctcaaactcttctgcactgtatatcctcaaaacctgtcacaaagaaaatagtatatatttctgaaaaaaggtacttattagaattaagtaattttatgtatctgattagctgctaaaactactcctgaatgtataaatagtgatatacacacctttaacatcaccatacacatttaagtttttgcaagagatccttgcctgaatataatgttcattttgtcattcaacaaagaggtaaaatatatgtggtaatatagaacagataacgaatgttttaagaaaagatatttattatttacaccactgaaattagtcctgtaagaacaatatacaccatgtttctttaaaaggatcaattcctttcaaatacaagaactgtataaagcaatattgtcaacacaaaacagtggtcacattacgtatctgcaggcttaagcattgcaaataatatatttttttaatcttatggctagatattttcactgaaacagtgttagcacttagacaagatatagctggaacagaacaaaaactttttgttcatgctttttaggaatgaatcagtgatatgtcccttttaaaaatttattgcctttaactgcttttatgacaatggttttaggaagattctacttagccaccaaaaagagactcattcttgttccttagtttttattcttcagtcttctgtttctcatactaagacacagctgtgtcaagactgacattttccagctttacttggacatgtacacacatacaggcctaactgagaccgctcagaatttagaaatgtaactagtggcatacagaagagaaattgtgtctatgacaaagaaataaaaaattcttggtaattttaagcatagcaaactaggttctttaattaaaaagtttttttttgtttttttttttggtttgtttttaaagggaaaagtactagtttcaacatgggtttggttttagatttagtcagacaataacacaatgagacaaaaacacaaaacataacttgtttccaaagtcacaaaatgacattgttgagtatacatttttctccactttgtgtgtgtgtgtgtgtgtgtgtgtgtgtgtgtgtgtgtgtgtgtgtggtgggagggtggggtggtcagtaaccaacgctggagaaaatatttttcaagcgtaacagaatattcatataggggacaagcattttttagcatattgctatcatcttcaaaaaatataaaattaaatttacaaaaaactggaagaccaagtataagcagtatggtatttgcttcagtgtccagcactatcataatgatttctagcataaaagcaagaagttcttggatcttaagtatcttcaataactgccagtataacttgtaactactgtccttgcttctttgagagatatctgcaagaaataaaataaagatgtcaaagctgtatcatgctaaattcatgaagataacctaactttgctcccaaaggagtttgttctaatgacaaaacatttcaagatgagtattcttaatagtcacttacatctactgattatgtgcacgcacagttctaagtacatgtattaattcatttagtcttcacaacagctctgaggagttactattagaattattcctattttacaggcacaaagaggttaagcaatttgcccaaattcacacagctagaaagtggaagagcctagattcaaaacaaggctccagaggtcatactcattgactaccactccatactgccttacttccaatgtgaaagtcactatattaactagtattgtaacttccaaatacagatcaaactccataaagatcttatttttgttacatcaagacagtgggcaaaagatgctaaaggtctttgatcaagagtgtaaaagatataagacattactaagcaaacaagtgtttttcatattgtttaatagaaatctaccactaaattaaaaacttgatctctatttctaacatttacaaactactataattggtggtgtggggatggggaaagagttcctaaaatcagcaaacttggacatgttttgctggtacaatttgctcactttgtggcactgcactaagtatttactatctccatgactcagttacatcatttgcaatttaaagatgggggtaaaaatgtctgctttatcttcctattaggattatagactcttagaagacttgtgtcaaactgatctgaaaagtcaaaagtggaatctgaaaagccaaagtgttattattacacaaatagtttcttttggtgctgtattactggaaccagatcctcaaagatctaattcccccccaaatactgtaatacatagtaataccttccacttctctggggacttttctctgtctcaaaaccttgatgtttataggcaacgtctatatagatttgtgcaaacatttgggtttagataaaagactgaaagactatataccaagatggtaacagtggttatctttaaaaaggaaaattatgagtaattgtttttttagtaggataaacttttctaatttctctgctacacacaagttactggtaatttttaatactatttatgaaatttttacatgtgttttatcttatcctgacattaagttacagtatgagaagagggattatattccatgtgattcataaaggagtagcttacctaacatcacaaaataatttacaggcagcatcaccaacatatgctagtctctcaagttctctcttctagaagtattaaagagtttacaagaggtatgtttatgaacaagttagaggttaagatgaaaggggaaaatacttttgggggtaggtcactggattagaaaatgtttttagaagtcacctattttaaataaaaattaagacagctatatatatactggggtcactgatgaaaaatgataattttttcttcattgatgtaaagagaaaataaataagcaattaaaacttacctttcccaatatttgtgatttagatccaaaaagtcatctaattttgctatctccttgaggtactgagttaattttaaaagttctttgtctttatcacgatttaggtgcgctttcataaaaggccttatctattaggaaacaaacattactcaacacatcacaatgtgataaggaaaactaacaaatctatactatcatttcaattagagttaatgaggttaaaatatcaccaagaacataaatactaaaaattacttttatattagcctaaatagaaagtcatgtataatgtttacaaattacaaactcttctacctattttacctaacattatcttttcaatctgaacctgacaacaccagctttcttattgcacttgaatccatacacagctactctactttgcaaaactacttagcctttcccgcctcctatcattctagttgcttctaattaatttcattcacattattttattcataaaaatttaaccccaataccagcttgatctaacagtacagtgagataaattttaacgatgatttttattttatttttctattaaatttttatatagctgagatatcattatacatttatataacctgtttcctcctacattttatcataagcatttttctttatcattaaattctctgttaaaatcatttttaattatgcaagagttttccataaaaagaactgccatattttccaaatgtttaaggctgatctattttatgatgaaaaagagtttaaaaagcattatttcaaaccacacatgtcagaataatagaccgaggtaggggactgcaattagtaaggaataccatatcttgacttgagtggcggtgctatgaatgcatatgtttatatgcaatcttcatctagatttgtgcataaatctatgcttaaaaagactagaggactataaatcaagatggtaatagtgtttatctttggaaaggaaaatcatgagtaattttagtggaataaaattttttacaagaattatctttacagtttgttgaactataaatttatgcacttttccttattttatagcttcagtaaagaattctgctgttttgtaaaagacacctgctcaaatatctttatacaactcaagatagtctttcaataattttaaattaattttagataatatgatatgactaagatttacttcaaaatattaaggagagggaagtagcgtatagagcaaacaataaccatccatgaattaataagctaatttaaactgaatgatatctacatgggggtttaagcaattttatatagttctgtttacatttgaatttttctgttatcgttaaaaaaaaatcatacatattcctaaagcacacatattcctaaagcacacatgtaaggactgatttcatcatacttagcaaagtattagtatattcttttgatttggagaaaatgcaaattggtcattagttttttttttttttggtcattagttattaattttacacagttaacactgaaaaatgaatgatatttaatcattgtcacttactgagaagcaagaacaatgagtgagcccaaaggagtctactaccatacctattaagtgtagggaagggtttaagtattttttacatacttttcttctgtcattggaaaaacaccacccatctgaaatggacagaagaaaattttcccaggtgttctactctcatcagaacagcttggtgccagtgacctccacactgttagctggctcccatactgcttgaagggcaccagtcaagagctgtcaaagggagtctcctcagaaatcagcatttgtgggagatcccacttccaaaaaggtagtgcagcagtgctgtttccgagcagcagtgaatgtgggggctgaagacgacgctttacagggccttgcttaggccctggggatgggagtaaacagagtcatgatatgaggatgtagtgaaatgagtttctgcataatcctgggtgatatggtaatgttttaaagtattccttcattcacttcctaaggactgaaaggtaacaaattaacttttaagcaattaatatataatgtaccaaagtgtccaaatttaaacagcaggaaattacagggttggtgggtagtaaataagattttcaacccaaggctctgctaagttatttttactttccaaacatttgctcttaagcactattaaacaacaaaactaaaatattctaatgattctggttctaaaattttaaataaacaaattaagggtgaaaatctatgcacctaattgacttcacttgctccagtataaccactgtttactgtacatttttaaaaactgatctaagtgatcactaaaaggacaggaaaccatcatcttgtctcaggtcaaggaagcatttttagaaacttaagactgtctagataagctgaattctcctatatcataatttccttgtacagacaataaaaatggagttttcagccgataaactgctttatccatgaccaagattcacattcttttagtgtaattctaaattcatattcacagtaccttccatgtacttcaaaccttatgactgacaagcttatgtttaatagaagttaactattttaaaaatgagcagtcttatttttaagatctacatgaaatctttgagatttctaccaagtgcattatgaaagcatgataacaaaacacagcatttgaggatatttctccattttagaactctttctgggctgggcgcagtggctcatgcctgtaatcctgcactttgagaggccgagataggtggatcgcttgagtgcaggacctcgagaccagcctaggcaacatggcgaaaccttgtctctaccaaaaatacaaaaattagccaggtgtggtaacgtgcgcctgtagtcccagttacttgggaggctgacatgtgaggatcactggagcaagggaagtcgaggctgcaatgagctctgatcatgccactgcactccagcctgggtgacagagcaagaccctgtcagaaaaccccacctgtttctatgccaacgtgggcagatctttaatcttaatcttaacctttaatctttaaccttaaaagaggttttcatgaagtgttatcttgggtagattaattttataaaaaagaggttttcaataaaagacacacaaggacagcctgtggagtgtctaaatctacctctggaattagaatttaggggatggggacatacgtatttttaggaattccttcagtgggtctactgagtacagtcttttaaaaaccctactgtaaagtaacataaagaactagacatttacaataacatctctccctgcatcaagagatgaatggagctcaaatgttggttaggaaaacaaagtttcttttaaacaaacatgaaactaatgattgtatttttttttttaaagttaaacgtctcctccaaaattattccttgaccatcatgggatcacctccttgcaagaacaggtaataaccattcgtttcacaaacaattaggtttacatcaaccacatttcttctcaagactcaagaatacatttttgtacctttacctggtgcagtacatattaagaaaagcacttctctccaagccttaaacagaaaccattaaggacaacataaccacttttcttccaagtcaacagtttttatacttatggcaattcactacctagattagtattctttccctaaaatatcctcattgtaaacaaaaactcaaatcaacagtctgtaagaaaggtttaaaaaatgtacttttaagtttttctctcttgtcttttaaaactaccaaggacccagctagtagaaaagtttaggactgagaatgaaaacatctcagtgtcaggactgccacttcgaatggagactccatgtgcaatagtgccatagtatagagctatcttttccattttcatattgcgccaacatgtaatcaactatgggtaccagaaacttttaaatttcaaatttcactcttaccaattttatactgttaccaggatgaaatgtcacataagactgcatgcagttgcatgctaagattgtcactgacctaggaaccaagtcactagagtctaacccaaattctgtcattagccagttacatatacaatcttgggcaagtcaggaacttcttcaacctcagactgtttccaaagttaagaaggtaggcaagagatgactgtggttccttctagctctggcaatgtctaattctaagatctgtacttgccgtctaggaattttcaaaaacgtctttagtttcagtttaaaaagaaaaaacaaagtacccttactgccatttctcaagctaaccagaatgtttaaaatgccaagatttgtatacctaaaaaaataactaatgatttcactttggatgctaaaagtcaatgttgggaagcccatgttgctcccacagagctaattaaaaataaaacacttgggccgggcgcagtggctcatgcctgtaatcccagcacttgtgggaggtcgaggtgggcagatcacgaggacaggagcctgagatcagcctggtcaacatggtgaaaccctgtctctactaaaaatacaaaaattagctgggtgtggtggtgcgtgcctgtaatcctagctactcaggaggctgaggcaggagaatcacttgaacccaggaggtggagattgcagcgagccgagatcgcaccaccacactctagcctgggcgacagagtgagatcccgtctcaaaaataaataaataaataaacaaacaaatacttggatgaactagctaactatggagacatcaatgcaaaaaagacaaagttcaatttctatatgaattattcttaaacttttctcgcctatgacataagaatacagtacttccaaaaatatatgaaattcaacagtgcttactacaaaagttctaccacacagcccagattacatgagcacataacaagtaaaagtatgtcttacctttagtccattctgtgggttcattagaaaatttctccctatgtcatcaaacataatggtgtttttcttgctgtaaaactccgaaaactttccccatataacaccaagaggctttaccttagaataaaagtttacatttaactcaaattttatcaatatttcatcctgtcttaaaagcaggaatactgcaaactgccctgcagaacaatgccaaagtgttcctttccccctgtaagacaggtgtgagctaatcattaaatgcaacccactttaaagcacaatgcattttgcaatattaaaacttctgaaaggtttgttcatgtccaactgaactaaacccattataaaactttccataattttaacgtgaagattttgggtaaaataaataaattatttaattttttaaaaatccaaagtaattgtttagatgtctgctatgcagtcacatgacttccttggttaacacattccttctcagagcttgggagtcacatggagtctgctttcaaaactagaacaccctagtcaaaaaaaaactgtatttggctttttcaattaataatttgaatattttatagaggaaaaactcgttttgtctttaactcagtggcacaggtgcataatttctagggaatttgattgcttaacttcggaagcaccatattttacaaattcttactcttatttctgaattcttaaactgaagcttcaaataaataatttcttatatagtcttacctgttggtatttgtgtaaagtctctgtaagaccacacaggaaataacactgattgtggctaggtaccaggtgaaagatgacttttcattatgtactttactatttttttagtcatgcaaatgtattacacattcagaaaattttttaaatttctagaaaattacttttgctgaagacagaagtcttacggtattatgagaacagaatgtaataataaatatatgagattaagtggtaagaaataaatagtgataaaagttgtaacttaaaaatttttttcctcctataatttaatttggagaaagctttttccttcctattgtcttgcctattacaaaaaatgttaatgaaatattttaatttactaaaattttactttcctgatttttttttgctactgatcttgtttactaccgaaatagaaaccgccccctactccccccacgaaatgaagacaaatatataagaattaatacaataagccatattttgtggatttttagctaacaaaagcctcaagaaatatgacaacagaggtcattttttatgacatccagaataaaaatcctacatcctcttaaaaagtgctgtcatttgttaattaggtcaagcacctatgttccccaaaacacaaactactttgctctcaattagaaaagtaatattgctaactacagaaaaaaaacatgaaaatactgaaaagcataaaggaaaattttaaatcaataatctagtcagtaccaagggcaacaactcaatattctgatacattgactccaggcatttttataaacaagagcagcctcagagagttgacaggttctttgttaaattaagggtaatcctgaaccaaacaaaggttaagaactattttctaacggcttacaacagtgttctctaaaatacttctttcacttaaatgtgtcatgaaaatttctaaatcattacatatcctactacatcaaatgacgagctacagtcccttatatgggtagcagtaatttatatatccaatgccctattgctggatattgaggattatttttattcctttaatttttcactgttataaaacatgtttaacatttccctaagtaatttttaatgttaagattttgtaaatgtattattttactttagtatatagtaagttatctttttctcgatacatgcagtatttcctttatagaacaagtccccatgcccttaaatcattctatttatggttttgataattttaatactgtctcccctaaggtttcctcgtatcctaagttctcctcaattcctattagtttgggtgcttttattttactttattttgttgagacagaatcttgctctgtcacccaggctggagtgcagtggctcaatcttagctcactgcaaccaccgccccctgggtttgagcaattctcctgcctcagcctcctgagtagctgggattacaggcatgcattatccagcccagctaacagtttgggtgctttcaaatgatatggactgtgtctcactcatctctttattcccaacagtgcctatcacagggccttccagacagtagatacttaatagtatgagtagttacttgatgagtaaaataactggttagccaaacccttttctctgattgttcttgttgctattcttcagcatcatcccaaagtacatgcatcatgatgcatctgcttttattaccagtttcaaacagggcagggtgagtgttttcgcttgtttctagtatcttccttgataatattcagtatttttctcacctactctgcccagtaacattgtgctgtcatcaacacaggtcaattacccacaatcacaagttcctttcttgacagtcctacttcaagatccctaattttatcattaaaattcaaatcttttaaccttggctgggcacagtggctcacgcccataatcccagcactttgggaggccgaggcaggcggatcacgaggtcaggagatcgagaccatcctggctaacaacagtgaaactccgtctctactgaaaatacgaaaaaattagccgggcgtggtggcgggtgcctgtagtcccagctactcaggaggctgaggcaggagaatggcgtgaacctgggaggcggagcttgcgtgagcgagattgcaccactgcactccagcctgggcggcacaatgagactccatctcaaaaaaaaaaaaaaaaaaaaaaaaaaatcttttaaccttaaatacattttcctatgtcaaaactcaaccactttattattcactcagatgaatctctacactatttactccataggtataaacataaaaagtacactggaaaataaccatggtgtcattaaatagaaataaaatgacttcttacgtctattaatcctctccttggagtatgtactgttatcatagcagcactatccaacatgaaagtaatcttataatttgcatttgtgctcactcccagctcctataaacacaaatatttgtgaggttaaaacatagtagtgtggaaaatttcagattttctgaatattctagctgcaatttctcataatgccaactttctacaccactggccactacatcttgctaaacaactaggaagtattttagtttcacttagccaagtcaataaatggtaaaccaaggaaaatagaaatagattacttcctaatttaccattttaggagaatactgactctttaagtattgcacactagagcaaaagaaggaaaataaagtattattgtaaaatgaggaagaatgtgggggaggggacaagcttagttatactttttcttaaaaaagacttagggattcagtacaatccacttattaaacacactttaaaaacacctctactcccaataatggcatttatctatctactaagtgccctccagtaagaataaaattaattcagttctagaacttttaacaagacaaatgcagtttgaaaatatttttaaatggattgctttctaacacttactttcattttagcttcaatccacttcatatttgttgcagctaaaacacgaggaatgataatacaatacatatgaaaagcttgaatttctttaaaaaaaatctgtataagtaagttttctaagcaaaactaaaagtttaaatgcatcagaattaacagtccctagcatacttatggtaattttcttttaaatattgataaaagtaaacttactgcagtgtgtcttcaagacagaataaattttaaacaacttttatctgtaagatacaggtaatccatgctcaaaagaactctgaacctaggaaatttataaatcaagacctaaactctctttttaaatcagccctgacactctatcaattccaaacttaaacttgggtgcctggatcacttttttccatgttcctacttctaggcaatgcacaggtatacatagtgtcaatataagcatattgttatgtgtcaaaagtttatgttgaaaaccagctagtcaggttcagtgaaaatctgcattttgtcagtctcagcaaattaaagctcactgagtctagcagcttctaacaagaaatgagacaaattcatgaagtatacctgcatcatgtatctgctcattgtcagacattaaccagctttgagatcattaatactaaaattaaatcctcatctttatgtgctctcctggtttactggactaaactatacaggtataaccaagtaaaatgtttaaaaagagaaaaagcaatttaattatttgaagtgtgtgtgtgtgtgtgtgtgtgtgtgtgtgtgtgatttttaaaagcaaaagaggaacctgagttctcaaaataaaaaatcttcagcatgcacacatacaaaaaaacagaagaatcaccttacacgtacaaaactggtcagttgagctaaaattttaaagactattgtatctccaatgaaaataatcataagatagaaaaaaattttaatccggtacttactttgtatctgtaattatcagacgaaaaacaaaaagacccacagctaataaaaagtttctaattattaagtaactatatgtcagacatagtactagttgctatattgatacttctattcttacaactaacctgtaatatgtatttagatatcttcatttctcaagtgagggaactaaggctcagaaagattaagtgacctgtccagtgtcacacagtaagaacagagccagaattaaaatcctagtctatttagctccaaagtgaagtactcttttcaatgaactaccacaaaatatcacagtttataaaaataatttaaatatactattgtaaaaggttctcaaattttataagtctagtttaataacatttaaaggataaacttttttctcaaatatcatcttagatgtcaaagttgctaaacaaaccagcaagctttcttcaccttatcttactaaaccagaaaattatatattttgacaataattttaatcttaacagctgtgaactcacatggaactcacatatcacaaacaacggaagtactctgattataaggaaaaatacaaaatgaatttacagactgcaacaactaacataatttctctcaaagacctagtacaatgaaatgtagcacctttacttgatgggacttcatttaattcagtcaggataactcttctctgcttatgacattgccaagaggcaactttaaatatttgtggggaggagggatgtaaatcaatgcattgcttcattttccaagaaaatcttgctaccaaaaaacgttaattgaactgaatagtgtgcttacgattacagtatatttacttcttggaacaaactcagtatcttatcacagacctgtacattcttgaaatggtccgcagaccacaatttcaatgtcactggctttagtccacatattaatttttccttaagtaattcaagttgcctttatttccagagaactatatcactgtgattttgttttaaacacctttttccaagtattttaaaactggagtcaggaaaaaaggagaaaagaaaaatattctgaagcatcaagaatttcacagcaaagatcagaaggaaaggctgggcacattggcttatgcctgtaatccagcactttgggaggccaaggcaggaggatcacttgagcccaggagttcaaaaccagtctgggcaacacagcgagaccctaaagatatgtgcctagttaaaaaaaaaaaaaatcagaaggaaaaacttcaaatcaaggtggggtcattgggaaaattagtcatttttattcttacactataatgtactcatgtcctatagttaaattaactatctcactggtatttggccaatatatgtttaagtttatattgtgatacatgcttcattttagaaatttgctaaaaaatgaaaactatttcatatttaaacacaggtcattttaagtcacattttatacagcacaataatatatggaacaacctatttccacggaaatctaaacaaaaaaatacagcttacaccaaataacaatgtcataatcttcataggcagatgttagaaattcatgaagatatggccgcattaattctaccccagtctctgcacaagacctgtggtctaaaagaaaattgatcataaataattattagtttaccatcatgaacaagtacctaataccaattattattaaatgtaatatattacgaaatgcaaacataaacatttcattgcaaactgcttcagactgaattacgttggctgacaaaaagatgtctttcaaaacacaatttaaaatccttaagatccaattttagtcgatcaattttgttcaatttgcaaaaagcaatactgaaaattcaggcttaagtagtaaactgaaaatttttttctcacctagtctctaaagtttagatgttattttttaataatgaaaaacaaactatgtccacttatactcacctttagtcatctaccttgcagatataatcacatttcatcaaaatgacaggccaattaaccaattaattaaatttttaaaaactgtacattaacttatgttttaggtttagggttagaaataaattccagtatcagaagttaactatttcttgccaacattagacataaaaggaacatctttctttttcaatgaacacaaaacatttttttctttctttttttttgagacagggtcttactctgtcacccaggttggagtgcagtggcactccatagctcactgcagtcttaatccgggctcaagtgatcctcccacctcagcctcctaaagtagctgggactaggtgcataccaccacatccagcgagtatttttagtttttattagagatgaggtcttgctctgttgcccaggttgatttccaactcctgagctcaagcaatcctcccacctcagccttccaaagtgccaggatacatatgtgagccactgcacctggcctacatgagaaattttaaattcaagaatctgcttgaatataactaaacagaaaactagtgataaaatatcaaacataatttttaaaatattccttataaaaaattatttataatcaacagggaataacatggttaaatgatgatgcatccataaactagaatactttctggccaaaaaaataaaaaaatatatatacacacacacacatatatatatatcattcataataaacaatattttactgagaagatgttcaatgtgttattaaataaaagatttagaggagatccatacaaacagtctaaaagatatatatcaaattactaagagtggtcatctttgggtatcaggattacagatgacttttttttttgcttatctgtattttttacaatgagcaatttacttttgtaataagaaaagttttcaagtatttcacgagaaccatgagttgctaagaaaaaaaaaaaacaaagaaaagaaaaaaagagttgttgtgggtaacagaaaatgaaaagcattcttaactgacttaccaaataatgtataatcaacatctagcaccaaaagctttttcccttccctgggaggattcaaaatttccactttgtactctttcactctgcgagaaattttcagtaggttttcttccctaatggaaaacatataattagataaaatattcacttgttctcacatgacaactcattacttctaaagcgaaaagcacttacctattttctacttcaactacttcatcttcaatatcaaagtcattaacaacatcatcattgtcagggggtggacctaagacatcttcctattaagatggaaaaagttttgttctaccatattatccttaatataacaaatacatgcatagcataaaaataaaatgagagatacaatttgagttccagagtcttttaagcccatactggaaaatttccacaattaataattcgttatgtatgtttcctgggcagatttaccatattaaatttgatcatttgtgctactactatacttatacagttaataacacattcacggtgcaggttttatttttcattgattgctagactgacaattttaccacaattaaaactataatacaacagtgtagtataaatcataatatcttcaaatggacaaatggtaacaaaaagtaaacatttaccaagctctcctcacgagttcccatcatcatgattttagtatttggtttcagtttgagagctccaagcttaacatcattttctgcaggtttgcctacaatacaagcaaatgactgttttctcactaaagttcaggtgctggtttcactattccattatataaaaccctaacattaaaaggtttggtacagatgtcacagcaatttttgttgttttgttttttcctacattaacaaattgtttctgctgaattagtcatatctaagacacgaagaagtcaaaattaatacaagggttattttctccccaattctatgttagatgaacacctttattcaactacctaaacaaaattaattcatgttttattctgttgttcaagatgaatattactgttttccaggaagccttaaaaattgagtgcctaagaaaactgcagatttactgttactcaaaactcactcttcaatatgataatcacaaaacaccataaaaaaaatcccttttaaactggatatgaatgctgcctgtaatttttaaatgttgtctttacttttgaaacagaaaagataatttgggaagagtacgaggccctcgttacaacgaaacactgtgctaaaaggtagatgtcagaaaataaatgagtttcatccgggacttctgtgccaaaggtttaacaagcaaatactgactgtctaaaacatcaaaagtaatcttaataatcatggtattttcgagaacactttaatattcttacttttaccactaaaacaattttaagaatatttctaccagagaaatctcgaaagggagagacttactaaactacaaatagcaagtataaattattaaacaattatattcaaaataattattaaaattcataatactaaaaattcaatgcaaaaaatctgaagaggggagagaattacctttaactttgagtccaagtaacttttggcgttctggaagaactcctgtaagggtcttgagaaactgtttgagatcgagcacagtatcatcttctgaaagtgtggtcactgaatactcctgtccaccccattttacaatgatagggagagccattcttgaaacatatgaggaagcagctttccttcagaaaaaaaaatacctggaaaggaagacaaaaatgaacaagttaaaatagatactgtttattgaagccaaacttttaagttttatgtgtacagtttaagccttattttacaacttatgatagagaggatttttgtccatacaggagtgctaccagaacaccaaaagatactaggactcaaagttaaattcccccacactcctaatttttggcttagagttactactttctaatactctgagtctcactgttcaactggaaatgtgcaattatgagctaccattcctcctgttctatttggtcaggttgatgctacaagcaagtccttccctgacagaccatccatgttcatttaacatttgaaaggtagtgtggtgtagttaagaacacagattctagagccagatgacctgggttcagatcccagatctctcccacttagccatctgactttgagaagttacttgactctcagtgtctaggtttcctcatctgtaaaatagggatgatgatactacctacttcttagggcttttatgaggattaacttaattaacatttacaaggtacatagtgcctggcacctagtaaacactacataaattaagtattggttaaacaaaaatctttttaaactaaaagcttactatgttccaggcaggcactgtgctaaataaatagtaaatagccattctttgtttcatattttatgaattgaagtttttacacaatctcattagagaaagtaatttggtaagttttccctcttttacaattaaggaaacaggagttttgagaggctatacaatctgtacatagacacatagctagttacagaacaggtcttctgactaaatcttatgtttcttctcctccacaattgtatctcttcagttgaacatacaagagttaaggcatcaaagatcagtgtattagtctgttttcacactgccaataaagacatacccaagactgggaagagaaagaggtttaattggactttacagttgcagaatggctggggaggcctcagaatcatggtggaaggcaaaaagcacttcttacatggcagtggcaagacagaatgaggaagaagcaaaagcggaaacccctgataaacccatcagatctcatgagacttattcattgtcatgagaatagcatgggaaagaccaccccccaagattcaattaccttcccctgggtccctctcataacacataggaattatgggagatatcattcaagttgagattttggtgggcacacagtcaaactgtaccattctgcccctggcccctccaaatctcatgtcctcacatttcaaaaccaatcatgccttcccaacagtcccccaaagtcttaattcatttcagcattaactcaaaagtccacagtccaaagtctcatctaagacaagttaagtcctttctgcctatgagcctgtaaaatcaaaagaaagctatttacttcctaggtataatgggggtacaggtattgagtaaatatagccattccaaatgggagaaattggccaaaacaaaggggttacagggcccatgcaagtccgaaatccagcggggcagtcaaatgttaaagctccgaaatgatctcctttgactccagatctcacatccaggtcacactgatgcaagaggtgggttcctatggtcttggatagctccacccctgtggctttgcaaggtaaaccctccctcccagctgctttcacgggctggcattgagtgtctgtggattttccaggcacacagtacaagctgttgtcagatctgccattctggggcctggagggtggtggccctcttctctcagctccactaggcagtgccccagtagggactctgtatgggggctctgaccccacaattcccttccacactgtcctagcagaagttccccatgagggccccacccctgcagcaaacttttgccagggcgtccaagagtttccatatatcttctgaaatctaggcacaggttcccaaacctcaattcttgacttctgtgtacccacaggctcaacaccatatggaagctaccaaggcttgaggcttccaccctctgaagccacagcccaagctgtaagttggcccctttcagccatggctggagtggctgggatacagggcaccaagtccctaggctgcacacagcgcggggaccctgggccgggcccacgaaaccttttttccttcctgggcctccgggcctgtgctgggaggggctgccatgaaggtctttgacatagcctggagacattttccccacggtctaggggattaacattaggctccttgatacttacgcagatttctgcagccagcttgaatttctccacagaaaatgggtttttcttttctactgcatagtcaggctgctaattttccaaacttctatgctctgcttcccttataaaactgagtgcctttaacagtacccaaatcacctcttgagtgctttgctgcttagaaatttcttctgccagataccctaaatcatctttctgaagttcaaagttccacaaatctctagggcaggggcaaaatgttgccagtacctttgctaatacataacaagagtcacttttactccagttcccaacaagttcctcatttccatctgagaccacctcagcctggaccttatggttcatatagctatcagaattttgggcaaagccattcaacaagtctctaggaagttccaaactttcccacattttcctgtcttcttctgagccctccaaactgttccaacctctgcctgttacccagttccaaagttgcttccacgttttcgggtatcttttcagcaatgccccactctactagtaccaatttaccgtattagtctgttttcatgctgctaagacatacccaaggctggccacagtggctcatgcctgtaatcccagaactttgggaggctgaggcaggtgaatcaccttaggtcaggagttcaagaccagcctggccaatgtggtgaaaccccatctctactaaaaatacaaaaaaaaattagccagaggtggtggtgggcgcctgtaatcccagctacttacagttccacaatggctagggaggcctcagaatcatggcagaaggtaaaaagcacttcttacatggcagtggcaagagagaatgaggaagacagaaaagcggaaacccctgataaatccatcagatctcatgagacttattcacttattcacaagaatagcacgggaaaaatcggcccccatgattcaattacctcccactgggtccctcccacaataagtgggaattctgggagatacaattcaagttgagattttggtagggacacagccaaaccatatcaatcagaaaatacaaaacccatgggtacagatctaagcacacaaagattatatagtggctgccactcatgtaaataaccaaacatatgtctcttcctgcataaagctttctatttttcattaaactcattcctcccacagtccagagaactggattttctaatctcaaggtattggtatttccaatgctttcacttatttgatgaaacatttgattgcactcttcatgcaactattaggaccaactgcaagaaagaggttaaatttttaatctccacttccaaaaataatttaaaaacagtgtctcctactaaaaggccaattagaagagagagccataaattcatatttatatttactcatatatgaatacaaatatgaactataaatgtatatttactcctatgtttacaatgtgttctactgaaaatgtaaagcaagtgtcttaatttagggtaacgtattccattttagacagaactataacaaatgttatattcttcaattaaaagtggaccttttgagttaaactgaaatacagtttaaatattttctgtaagacataagaataaaagggaatcctacgagagctagaaaggcaaccagcactaatatcgcatatattgtgatgcgtagtagtgcagagtttggagtgaaatcatctgagttccaggtgaccctggacaagtgattgctcttctagactagtggttttcaaagcgtggtccctgggctaaccaacagcattgacctcacttggtaatttggtagaaatgtaattggggtggagagaagggacctaggaatctgtgttttaacaaggtcagtcctcctcacctctgatgaatgctcaaatttgagagtcagtactacaggctcttcaatgttttcagccttaaaaaaaatgtgccagagggcatgggctctatatggttaataaagcagcataaaaacgttacgaagcacctatcccacaagtggaaattccaagttggcaaatgccttaaagggccaagcgaaacaaacaccataaaaattgtaaatgcatatgtctttaagatttgtttaaaagttactgaaccttatttcatcattaagaccgttcacaccaatgaagcagtgtgatataaatgcatgagctattttgctttcacatttaaccttctttcttagtattttgtatcatttcagatcccatcagatttataagctgaaaaatgatttggggtgtggggaggagtgaagttggcaaacccaaacaagcaagcaaagaatacacttccatatggtcaacctagggtcaagaatagctgtttaggttggagttctacctaacatactgtgttgactttgcctagtcaatccacctcttggcctcagtcttctcaacaagatgaggctactaatattcactggacaggagtagtgttaaggtatgaagtaacacctgtgacagcactttgtaaactgtaaaacacaatacaaatggtgttcatgatggaataaaaacatgctaaacaattatctcattgaagcttcacaatcctgaaccaacagctgttgtcctcattatacaaatgggaatcctgaaaagaaattaaacttgcccgggaccacaaacctaaaaagtggcaaatgaagaaattttaaagtatagcagtaaaagtaacactttgggaattaacgggaggttaactttcaacaatcccagcaaaagataaccgtgaagcactaagaactccggcgagaaccgcacaccagcaacaactgcgaggtggtgcagggtcgggggctgtgctaactgacttaggggagcattaggaggcaggtggaggctccagaaccaaaaaggccgggatgccttcaacaaggaggttgaggggagggatggacaagcctgagaagacggaggaatgaagtttggggacgcaaaacccactgggaaacagaaagccctccaaataggctagactgctggatgggaggacagcggcccccgcgactaagcgggccggggctaggggcctgggcgtcagactaggacagacactatccccagcccgccgcagtgcaagccacgccgcgcgggccgcaaagccactgtccccgagccccaacagcgtctccaagggcagcgcgccagggtgccccgcaacccctcacctggagcgcggtggaacctgcggcagcggacgcagaaaccggccgctgagagaccgaaagcgaccggaagtgaagggcgggaccggaaccggctgaaaaaccggaagtgggtggtttgaaacggaaatatgttggggacggaacaactgcttcctttgaatctcttcgggtgctaatcaaatggccgctgtaagggatctccacaaagccacgaagaagccaggcctttccgagactgtaaccgctgtgcagatagcgccgatccctgggtggccgctctctcgttctgcgcgtgcgctcgttctgggctgggagcggatgggtgctgaggcgtgtgacgtctctagtagtgtcgtaactgggtgtgctgccttttccaggtgtactgaggtcttcgtgagattcagggctaggactcgtgtggctgtgtcatgttccgaatgaagcttaaaaggtgatctttgagaactgaagacttgagacccctccatgggcccaggggctgccaacactaataatttcagagacttagaatctgaggagaatctccaatctaaggggaaacggaagagggtcaggaaagagaaggggcaagcttaagtgactcagaatccaagaagcaagtctcataggagagctgcgatcgaggttaccatacagtatccaatcgtctcaaccttcccatccatacttccatgctgtctttcctctgaatgcaaggaaaaccggttacacaaacgctgacaaaagaatgtcagacttgaatggaaattcggagcagtacccatctggtccatacagcgaactcccagtgagcaccacggcaatgtaactaattcatgtttccctcttggcagtgcgggaaaggcagcaaagagccaagttttgtatcttaacagttctttagttaagaggcacacgctattttgcattcttccctacttttgataatttttggctgcactagtaatgcatgagtatctgctcatttaaaaaactcaaactttttcagtgaaaagtatgcccttttcttcagaaagtcttaattaaaaaaaaaaaaaaaatcattgcccagaccaacattttcaagcattttctcaaatcgttttcttggaatagctgcatagttttgggtcttacattgaagtttggtgctcatatgtgggagctaaaaaaaagttgactccatggagatagagagtaaaattgtggttaccagaggctgggaaggataaggagggagaaggagatgaagagaagttaaaaggagcgaaaatatggttagacagaaggaataagttgtagcgttccacagcacagtagggtgactatagtaatcaataatttattttgtatttcaaaatagaggagaaaggttgggatagtctcaacacaaatgataaatgttggccgggcacagtgtggctcacacctgtaatcccagcactttgggaggccaagacaggcagatgactagaggtcaggagttcaagaccagcctggccaacatggtgaaacccagtctttactaaaaataaaaaaaattagctaggtgtggtggcatgtgcctttaaccctagctactcgggaggctgaggcatgagaatcacttgagcctgggaggtggaggttgtagtgagccaagatcatgccactgcactccatcctgggtgatagagcaagactatctcaaaaaaaaaaaaaaaaaaaaagaaaagaagaacttttgcctcctgttgctccctggagcctctcttctaatgtgtggaggataatatacttgtccttcattcatgcatctctgtagcagctaaagatgcctgggaattcctccatagattgtcaggtctgagagtctaaataatatatggaaacaatttcacaacatcagatgacaaactgttaatattactgtgaccacatttactttggaagataaaaggacattcctgcacctaggccagaaatcccccactactctgcttttatctccatctcccccagacttttttctccccttttctctctctggccattttctttctctagcaagtgtgttctcttgcccagctcagatctactcccctcaaaaagctttccctctcttcccagttggaagacaatcctcttcaaaaatttagttccctctagaagtttgtctctctcttctaatacctactcctttgcctttatcttgcctgcagtaagagagctgaaaatatttagaatctgccccacatgacagaatacaggttcttaatgaagcatgcccagttactgcccttctctattcagcatgctttccccaaactactacttaaaaactccattctcttcaaacctcagaacttccaatatactcctttgctctaggcagatgacattgtcccatattttggcaattcttcaaacctctgaatctacaaactaaggtatattttcagtcatcctcactcttgcttatttcagttgaggcagttcgcttctatttgaagccaaccctttaacttgttctccggcttcttccttctaaggaagctttctataaatccaggattcccttctcttgctcttgtatttttaacctctttctactggctcattcccatcaataataaacatgccatggtatcttgccatcatagccatcaccctttcctttcacagatggatattcagaacattgtttacagttgtctgaacttgacataatctataattgtatacttcttggaaatattctttctttagtgacattctctcccactatattgtaagcatattagttttcacactgctataaagatgctacctgagactgggtaatttctaaataaaagaggtttaattgactcacagttccacagggctagggaggcctcaggaaacttacaatcatggaagaaggtgaagaggaagcaaggcatgtcttacatggcagcaggagagagagagagcgtgcacgcaggggaacctgccccttttaaaccatcagatctcgtgagagctcctcattatcatgagaacagcatggaggaaaccacccccatgatccaatcacctcccagcaagcccctccctcaacacgtggggattataatttgagatgagatttgggtggggacacaaagacaaaccatatcagtaaattttgttaaggaacagacaatttattcacctttccattctcagaacctagcatgatattggctaacatagatgctcaataaatatatgctgaatgaatgaataatgaatgttaagtaataagagcttatgatgtaacagttgtcctttggtattggtaggggattggttctagggcccccaataaataacaaaatctaaggctgctccagtccctgatataaaatagcatagtatttgcatataacctatacacatcctgtcatacactttaaatcatctctcaattacttataatatctaatacaatggaaatcctatgtaaatagttggtatactgtattgcttttacttccattattttttattgttgtcttattatctttgggtttttcccctaatacttcaaacccgaggttggttgaatccgtagttttggaacctgtggatccagagggccagctgtacatattacgcttgtaacaatacatatcaatgaatgattacaatttgtatataactctggaggtacaggaaaggtctgaaatgcacactaaaatcgtgatagatcatagctctataggatgtattcagtaaatatttgttaggtgaattaatgaaattatctgtggcatcacagaacaggcaatttccatcttgtttatatttttatgtacatctgaattttttacagttttacattacttttatttcttttttatatgagaagttcataaaggcattcttttaaaaaatattgaaataacacagatacgttcataactctgctaactttttgtagtgcctatcattgcttttctagactttatacacacacatacacacatatgtatagtttatgttattttttttttatcttgctccgttactcaggctggagtgcaactgcaccatcatggctcactgcagccttgacgtgctgggctcaggtgatccacatcagcatttcgagtagcttaaactacaggtacgcgccaacatatccagctaattttgtgtgtgtgtgtgttttctagggcagagttttgccatgttgcccacgctggtctcgaactcttgaactcaaacaattcacccatcttggcctctcaaagtgctgggaattacaggtgtaagccaccatgccttttatgagacttttatgagactttttaaactctatttttagataattgtagattctcctgggaatctacaattatctaaacctacaattatttaaaatctacaattatttaaaaataccattatttaaaaataattataaatattttataattataatgatacttatatttataattataaatacattactttataattataatttttaattattataaacttctgcaaaaagtcatttgtacccttcactcagttttccccagtgaattacatcttatataactatagtacatcaaaaccaggaaattgacattgatgcaatgagtgtacatatagctctatgccattttatcacatgcggattcatgtaattaccactatgatcaacacaaagaactattccatcaccacaaacatagcacttgtgttacctctttgtactcacatccatccacattcctcggaccactcctaatcactggccactaatctgttttccacctctataattgtgtcatttccagaatgttatgtaaatggaatcatacagtataagtgttttgaaatcagcctcttcattcatcataaggcccttgggatccagtcaagctattttgtgtatcaatagttcatttctttttatggctgagtaggattccctgtgtggatgtacaacaatttgtctagccattcacttactgggcattttagttgtttctgagttttgccttttagaaataaagtagactgtttgtttataaggtaattcgtaatctgttgagacttaagtcttccaacccatattttgttttctgtttgttgcttctatttttagtttttctatttttttcttgtttttctattgatttcttgaatattattttagaattctattttgatttgtctgcaaggtttttgagtgtatctctttgtataattttttttagtttatctctgtaaattttgtagtggttgctctaggtattacattatatttacataacttaaaacagtcaattagcgataacatgttagtagttcaagtgaagcgtaaggggatttattagagggattggctcacacaattgtggaggctgagaaatctcttgacaggtcgtctgcaaactggaggctctgggatgctggtagtgtggcggggtctaagctccaaggctgcagaaccagggaagtcagtgatgtaactccgagtccaaggacaaaggtctgagaacccagttggttggggagggagggtgacttttgtgtaagtcctagagttcaaaggctggggagcctggagttgttttcctaggacaagaaaggaaaaagtgcatcccagttctggcagatagagtgacacattcaccttttctctgtttttgttctttctgaacccctagcagattggatggtgcctgcccacattgcgggtggatctcccccagctagtccactcagacccacacactaatctttgctggaagcatcttcacagacacacccaaaaataatgctttaccaggtttctaggtattccttaatcaagtcagattgacatctaaaattaaccatcacagtaggtctgctagcaacaaaagctcttagtcttccttcatttgagaatgtcttgatttccgctttattcctgacgcatattttcactgcatacagaattctgggctggctgttcttttcttttggcacttgaaaaatgtgcttctttcttctagcctccaatgtcttagatgagaaatcctgtgactttctaattgttttctactctactcataagccattgtttcccttttgctgctttcaatatttttatcttttgtctttagttttcaaaagtttgactaatgatgtgtcatgatggggatttatttgtgtttatcttgtttggggttcactcagcttctttaacctgtaagcttatgtctttagccaaatttgggcaattttcaaacatgaattctttaaacactttttgaggtctaccctctttctcctctccttccagggctctgacagtgcaaatgttagatattttggtatagtctacaggtccctgaacctcagttcattttttttcagtccatttttttctccattgttcagattagataacttctcttgttctatcttcaggctcattctttcttctgtcccctccattcttccatccattgattttttttgggatattgtatttttcagttctaaaatctccatctatttttctttataccttctattcctttgctaacactttttattcattttgagcatgttcttagttgttcattgaagcatttttatgatgactgctttaaaacccttcatgtaggctaggataacgtcattccaacatctgtattatcttggtgctgaatcttatttaaattttctgtttcagcaggcttcctctgacactgaattgttaggagaagggagatgccacctccaacctctctgactagggagagagtcaaagctctccatcaggcctcccttgacaacctaggttggtggggaaggtatctcattactgctgagcagggttgggagttcaggctccccactaggcctccactgataccaccctggttgggagggagagggatgcctcattactgccccatgtaactgaacctaggttcagctgctcactgcttgaaagccagacatgaaaaatgatggttggtggaaggaaaagcagatttattcagatagccagctaactgagaagatggtggaccatcattctaaagtaccatcttaagtcaagacaaattttaggctctttttgtgtaagggtaaggggacaaggagggagttgagatcaagagatgaccaataaccacagacatctgggcaccagtgagggtccacagtggttgggaacttctttgtcatgtgaaaatgttcctataaatctttaacaaaatatagttagctgtttacatacttctcctttaatcctagagttcatttttaaaactacatgattgctgtttttgcatattatctcagtgttctaaaattatcctagcctacatgcaggaatgagtaaaggccccttaaaaaatggattagttatgttagttcttttgctgtttcactgtcatatcctcacgtggcctccaatgacactttggagggtgtgtgggggactcattaccactggaagatggtgaaagttgggcttcccactcagccttctctgaaaccagcctggtgggggtttagaggaccctatagtccatcaagggtgaaagtctaggcttcccagtcagctactactgatcggtgggggtgggaacactcctttttctgtgatatttggttggagtatggcagtgtgtcagaggtctccaagaacactcccaggttcagcgtttcattaggaggactcacaggactcagcgtatagttcctgtcacaaataaaatgagcaaaaggaatagcctcgtggaatgaagtctggaggaaaccaggcccaagattctaaggattctctccaagggaaattatacagagcacacttaattttgttaacagggaactgtgacaacaggcatgaattgtgtctacaaaggaagattattagagaatcagtgccctaggttttggggacagttgattattgtattagtccctttcactgctgctataaagaactgcccaagactgggtagtttataaaggaaagaggtgtaattgactcacagttccacatgtctgggttggcctcaggaaacttacaatcatggcagaaggtaaaggggaagcaaagactttcttcacatggcagcaggagagtatgtgcaagcaggggaaattcagacacttagaaaatcatcagatctcatgagaactcactcacaatcatgagagcagcatgggggaaaccactccgatgatccaatcacctcctaccaggaccctcccttgacatgtgggaattatgggaattacaattcaagataagatttggatggggacacagacaaactatgtcatcatgtagatacccactgtcttgcacctatcaaaactgcagactctcagaaggaaagcagctgtgcagcagaagctacattgtttgccaacagtctagtctcagtgagccattcttatcatttggggaaagtttcatatctgtataggaactgtaggatgttcccagatgccagccaaagaccaatcttgcaagcaagaatttctaaggatggcaggcttaggcctcccatggtaacttttctgcatatgtggttattaactaaatgttttctgccttaccaggctgttcctttcctggtcctttgtctagagacagcaggcttggggtagggatgggggagtgttacatgaaccccctggcatttctaggttgcctgtattgccagtacgtagtctgggatatatgaaacaaaaagaaatcccaaggaatttgctagcatgttttttaaggtaaatagccaatctgccttatttctaccttccagagtccccttatatttattttacatatactgtccaggatttttagctatacttagcagaagaatagggagacgtgcaactggaactgtcttggaactggaaatctctgtattacttttacaatgagaaaaaaaggcatttttttgttttcgttttgaaaacaaaacatatctatatatgacacagcaaacaaaacaaaacaaaataaatgaataaatatgatatagcaagcttaacctaaatatagggctgaaaagttaccaacaggagtgaaaaacattatcatgacttgattccacttattctaacagtaaaatgcattttctctcatttataaaaataacatgtactcggctgggcgctgtggctgacgcctgtaatcccagcagtttgggagtctgagttgggtggatcacctgaggtcaggaatttgaaaccagcctggccaacatggtgaaccccatctctacaaaaaatacaaaaaattagctgggcgtggtggcaggcacctgtaatcccagctactcaggaggctgaggcaggagaatagcttgaacccaggagggagaggttgcagtgagccaagattgtgccattgcactacagcctgggcaacaagagcgaaactccgtctcaaaaatacaaaataataataataataatatgtactcattataaaaaactgattctacttttctttgacacaggtggttaatatattagttttctttatttagtaaacaaaatgaaaacttcaaagttagtaaagattgcagggtggcagaatatctacattcatttaatttcattatcatttatagagaagaatatagagtagaaattttcccacagtcaaagggtggaacagaccttccatagatgtcccatgcacagttttaataggaacaataaaatgtgtgcttctcttttatatccaaagtcttgtgcattagagatagtatcttcttacttatggaataataattacaatgtcccaacccacaaattctaggctaatgaaactatttctgagatgaaaattttagcataatatattgctgcctaatcacattcactatgaaatcttaaaaaagaacatcaaattgttatgttgtagtatttaacattatgaagtaatttcatttatttgtttttttacatccacagtgactcataagtgaataaattaatatctcccatgcttcaaaaaatatcaatgaaatgtttagacagttacaatctaaacatttacaacacaacaaggca

SEQ ID NO: 18 - DNA, 42252 bp, Homo sapiens
taaattcacaggactgttgggaggtattttaaattttccaagggaaagacaggatcctccatatctgttgaacactgcacaaactcagggttgttcatggtttcaacattagattacgtcatattcctttcagtgatggcatcttttggggaagccatgtttttggcagttactgtgacaaaaagcaagtgccacaaggaaatcagtgtggaacaggaaatgaaggtggcagtgtccactctgattccaaagtttaaggagttgcacagtgcccagcaggccacacatcccatgagtaagtaattgtgatgatttcagaatacaaaaaaatattttttttgtttcaatgtatcattttttttcaaatggccaatacaaagtttttagcacataaagacttttaagcgatttgaccctaactagttaatcaatgaatctatttggtatttcttttggcctacagatgccatgaaaaaattactgaagcactaagcgttctgcgaccaaggaagatttggaaacttctggtctggtcaagtcagccatgtttcacagctcccaagaacttcattggtacctgatcctatgacaaagcatacctgggtcttggttttggttatcgtggttgtttcatctcagagacttttacatattttcagtgctaaatgtgcctactacatggggcctgtgcagccatgtgcctcggccagcacctgcctcagactccctgggcatctctccctttcctctgcgcttaagtcacaccaacctcctttccattcctccaacccgccaagccctctcccattgtaggggcttcttactgattctcatcctggttcacctgtaggtcccaacttaaatgccacctcatcagagagccctcccctgtgattctctgtctcaccacccattcatttccttcatagcattttgtcctctgcacatatctatttagctctatgaggacagagtccaggtctgatctgcttactacattcacagaatttagctgggtgcctgatatgtaattgtcactcaataaataaccgcaaggttaacaagtgtcagtttaaatcatacacacattttaactggggccctgtgcagcccaaagcatttcagaaggcttttctggcaaacagcccatcagatagacacgtgggacaattgcatcactagccacaggcagagacagtcaagggcggtgtttgcgatcaagaatcccagctctgccacctccttgctggcagacattgggcaagttactcattctgcctctaccagccatgtctttgcttggaaaagggttgttaaaaggactaactataaagctcttaagtaaaatctgtcaagaaacaagcactctaaataaaagtaagctgcttttattaggacaaggacagtgttcaaggactatcccatgaatgcccacacaccattctgagaggaagtttctgcctcagaaactgacaggtccaatgcttcttgcttgttttagaataaaaggctcaattcaaaaaatgatatatggacaattaattcttagccccattggtgtcccccacacaactcatgattaaaaccaaaaagaatctgttatggaactttgattatccagctggacaacagaaatggagaatgttaggcagtgactgtcaatttgtctagactcaaactgctctatggcaccaagcacatggtggaatgtgtgtgcctaatccttccagtcctttgcttgtccccttctaaccagctctcttcatgttctaggcttaaaagtaagcccagtgcaccatgatgttgttccggttgtacctggggagttccaggggccaagggctgctcacagtcacagagaggaaatgacacatggctcctcttcttgcagtgggaagaagcatgagtaccagccttcatctgtccacaccttagttactgttgctctctttcctgggtctccttcgcccagcctctcccctacctgatcctcatgtctggatgcctcattttcacaaccccctggaatcacatcactctcctccccaagcgctatctacacttcctatttcatgcatacccacatcttagaaaaccatttctcccactggcttcctatagatggcctagctaagggtaatgtcttttctgctaacctgatttgctgtcactttataaattttatataggatggtcttacaagacagatggtactgatggactcaaacacgtgatgtgtttcaatcccagattctccatctactagctacatttttcatggaaagttagctttacatctctaagcctcagtctcctcaccagtaaagtgggcagaataatttccacctcatagctttgttgtgagtacgagatgagaaaactcacatgaaacacacaccacagtaactggtccacaggaagcacacccaaaaagtctactactgtggttgctgaggtcaaccccccatttggtagatctcagcttagacatcatctattctggaaaaccttccctcaccgccaccccgaagatgtgtgtgcatctaaagcacccttgctgtgattgtcattgcaaggcgtgtcacactgccatgtcattgcctcttagcttttttttcttttgccccctagaatactgtgagcacattactggtgggggcagtgttccttctactggggcagagcacctagcacaaagtacgtgctcaggacatattctatcatattaaaaatagctatttaggccgggcacggtggctcacgcctgtaatcccagcactttgggaggccgaggcgggcggatcataaggtcaggagatcgagaccatcctggctaacatggtgaaaccccgtctctattaaaaatacaaaaaaattagccgggcgtgatggcgggcacctgtagtcccagctacttgggaggctgaggcaggagaatggtgtgaacccgggaggcggagcttgcagtgagccaagatcgagccactgcactccagcctgggctacacagagagactccgtctcaaaaaaaaaaaatctacttaaacaagcaatctaataaagatgaaattttgctgtgttatacacttattattgctacattggaagactagactcccttggcaaccaaacacattcttttttatattatttaattttaataagagttaccatatattgatccatcttctatgccaaatgtaacttaatccttctatcagttctctgaggtagatattatcagtagtcccatcttataaggaaaatgaggctcagagaattgaggtactttgcccaagatcattcagctagtagaacagagctgggacccaaacccaagaccattcatctccagtgtctgtttgctttgctgcctccaataagactgaggatgccactttcctttttgttaaattttctggcctcccaaataccgtagagtggcatttcattattattggcacctacataacaaacatggtaatgcctttgatgtaaattcctttggtgactaatcaaccccaccttgccatatttttgtctttggcactatttaactttcatgcttcgtcaagtctccttaactggagtgtaactggctggtgacagtgccaaggtcttaagattctttctgtctccccaggtctaaaaggaacatctctcacctactaaaacacataaatgaaattgggtttctgtctatttggctgttccatgttcaagtaaaatgactagaagatcatcaccaagtctgaagggtatttgggacagcttgatttggatctgtggtatacacagctttcacactgggggaccagggaggcacctcaagaagatagacacacttagtaacctttgtactatttgactttttttttttttttttttttttttttgagacagagtctctctctgtgacccaggctggagtgcaatggtccaatcacagctcactgtaacctcagccatctgggctcaagtgatactcctgcctcagcctcctaagcagctgggaccacaggcatgtgccaccacacctggctaattttttaaatttttttgtagaggtggactttcgccatgttgcccaggctgatctcaaactcctggcctcaaacaatcctccctcctcagcctcccaaagctctgggattacaggtgtgagccaccatgcccagcatagtttattttaaactagaggcatgagttacttttttaaagtaccatcaagaataaagatagatagatagatagatagatagatagatagatagatagatagatagacagatagacagataaattttcaaagccaaaaattagagagaaaatgacagggcagaagaccaggggtcatagttattttccagagcagatttccagaacaagatacaataaaagcctgatgaatattaatataaattttctgtgaatggagaaacaaatgcgccttaaatgtgagtcccaaatcaactgtcacaaaggaagatgctccaaattgcaggccccgatttttggtcaatctatttctctccaggagaattctatgtgctctagggtgagtagcagcagtaatgtactttattggatggtgctttaacaattcatcctataaatgcaggggatgctggttaatattcaataattgttggttggaggtgatgttgataggggaccctcagacaatagatgccaggacttcaccacaaacatctgcccactccatgttgttcccaccttgtcttgttctatctgtctctactaacagcaagaccagaccaactgttctcatacctttctagcataagcatttctacatctcagcaatcctacaacctaggacacacccacttccttccagttgcccacacacccatttctttcactgggattaccaaagagttgaatttagaaaggaaaaaaaaaaaaaaggtttccatatgcaaatggcaaaatcaaggtcaaggtggaacacttgctctgcagtcagtccagttgagcaggccaaaaatgcccactgggataatgaaattcagtagtgactgcatctaccaccctctgcccttatcatgggccaagggtggaaggacgatattgaaaacatgtgatcacagtcatctttgaaggggaagaaattaatgaggacattgtaggccctttgaaagtgaagctgattctaaccacccagcgggttctccttgaaccactgctcagacagagctgaattatccagacaggggagttgcaacagagaaaaagtttaattcatgcagagctggctgtacaggaggctggagttttattatcactcaaatcagtctcactgaaggctcagaggttagtggtttttcaaagatagcttggtgagtagggagccagggagtaaggaatgctggttggttgggttggagatgaaatcatagggagtggaaactgtcttcttgtgttgagtcagttcctgggtggggcccatccggttgtcagaaatgcaaaaacctgaaaagacatctccaaaggccagtcttagattctaaaatagtgatgttatctgctggagtaattggggaagttgcaaatctttattcctcctaagtaatggctggctaggcatacttcctaacagaattcaggcccctctcatcctcctaacttggtggcctttcattagttttacaagggcaatttagtatctgggaagggccattataatttaactaaatttctcccaaagttagcttggcccacacccaggaatgagcaaagatacccagaagcaagatggggacagttagggcagatccctttcactgtcataattttctcactgttataatttttgcaaaggcaatttccactctaggaatcttttgcaaagcattaaaacaaaacaaaacatgcattagaaaggccactgaaaaactgaatgagctaactcaagcagttttctgcctccaggaaataccacacctaaaacagatgcttcctcatcaccatccataaaagtacaacatttcagcagtgacctggtgaaatgcatccatcccaggagaaggttctcagctatgagcacatgtaattatatttgaaatatggactatggtctaactaggtctgtcagattataaaacacacattcttgatgcactatatattctgccttttgtgtgtgcttcacttatctcttcttcggtaacttttttctttttttctgattagaaaagtaatacaaggtcattgtagacattctggaaaatttaagagatcattaaaaagaaaacaaaaataattcgccctcataccactcatatatacactgttaaattttgtgctctagaaccttctgttaccactagggaatgtatctaagtcacgtggcaccaaaatcacgtggcaccaaagtatgttagtggtggtgaactaacctcagttcttgcctcctcatgaaacatgaggttttccttgaccccttcagagtcctcctgacaggaatgcctcacttactcagtccacagctctcaacccctcatgggcgggggggcagcacacaggtgagcaggtgcaagagccagagcaaatgcttttgggcaccggcaggaccaaaactctgtgcaggccccacagcagcatctagggtggagtacccatgacccctgcagccccacaggacatatgttacagtgcacttttttagctttgctatccatggttggattaagtgtttaacaactcagtgaaccctctgcctttttgcaagggcagagggtcagtgtgacagcctttagcatcctcacccatggcacctgagatctcgtttggtgtccaggaaaaatcaggttgcatgaacgaattgaagggcggtgaatgtggaggattttattgccagtggaagtggctctccacaggaaggggaggtggaaaggggagggaccgggaaggtattcttcccctgaagtcctgctgtcaagtcatccctctgaagtcaaactgcttctctccagcattcagctgcttcttctctcctccccttctctgctctctgccagtggagcctggggtttttatgggtgcagaatgtgggggcagggtgggccatgggtggtttgggaaacggcaacattggagtgggaaaacaggactacatgttctcactttgggccacagcaccaggcttgagggtgggtctttgccaaaaacccccactcttttctgcctagaatttctctgtctcctgtccctattactcagaagaaagaatttgaccaaagggcttaagacagagtgagagacccaggcaagttttagagcaggagggaaagtttatttaaaaagttttagagcaggaggccagacacagtggctcatgcctgtaatcccagcactttgggaggccgaggcgggtgaatcacttgaggtcaggagttcgagaacatcctggccaacctggtgagaccccatctctactaaaaatacaaaaattagccgggcgtggtagctgtaatctcagctactcaggaggctgaggcacgagaatggcttgaacccaggaggtggaggttgcagtgagccgagattgcgccactgcactccagcctgggagacagagcacgattccatctcaaaaaaaaagttaaaaaaaaagagaaagttttagagcaggaacaaaaggaagtacacttggaagagggagggtgacttgagagattcaagtgtatggtttaacctttgatttggggttgcatatgctggcatgcttctggggggttgcctcccttctcccctgattcttctcttggggtggcctgccagcacttgggaggggccacatacacagtatgtttactgaaattgtacgcatgttcacttgaggcattcttcccttactagttgagtgttcttagaagaagctcatacaccagttaaattcgaccattttccctcctagtgctcatgcttaagcccattcgcccagctcctaagatcttatccggaagctgctaatcaccagcttcaggtgttctatctattgggagactgcctttccctggtaccagctgtgaccaattattattttagagaaacagtttaataaccatctgaccctcacctgatggttgcctgacattcctagtggtggtgggcggggagtggcgggggaaccctcttctgccctgctcatgtctgactagctatctgccgtgacacttccactcttcttttggtaagagcatgtatgtatgaggcaggaggtagaagctacttcccatactcctaggctagaagtatcccttcaaaagcaactgaccatttgggggaagaagccttagttttcattatccacacaattgccctatttctgcacttcactggccgcacaaatcacttggactcatgtaacagacacatgtgactgtatccataataggttcattgcccattgcacacagcaagtcaatacgccgagaggccaggttgcagcagagaaagaggtttaatcgtagggtcaccaaatgaggagacaggaagaaaccttaaatctatctccttgtggcatttggggctagggtttttaagagtttgggagtgggctgatgtgttggagatggttgactggttgaagagtgcatggtgaagtcatgggacagggtgaagctgtattttcaacctgatcccctttctttgtgggggttttcaaactgaaatatggtagaattggggacctgaaaaacaacttaagtgattcttaaacaaaagcgttctgattgtaatgtcagagatcccatctaaaggaacaatagggatacaaatcaattcctacacaatcttatgaccctaatgtcagaaatcctatctacaggaataatgcagatgcaaatggtcaggatctagtgctacatgactttgagcaacaaggaagtgggccaacgtgcaacctaatcaatgcttaattataactatattcctgtccagaacccagcatgcaattcttgtcaaccctgtgagggtggtttcatgactctcaatggcctaccactttccatctagtagggcaaacctgccttgtctatcactttccttgtaataagcccattctccttgtcagggagtggtatacaggtgataagtgagacttcatgaaaaggctatggagcttgtagggcaaattatttgctcctaagagacatcaacaggacaagatagtcttttcttatcccaggtgttatcagtccttagtggattgatgcctggaactgcagagctccttagaaaactaagcccagggcaacctaattgatgcagacgtgaaatctgttcaagtgacctctagcaagtcactgcaagtgactgaatacaaaatagactgttgcaagaaaagagcaacttgcagaacaatatgtatagtatgattccatttatatagccagatagatataaatacatagagaagcattcagaagctctgcaggaatgctggcactggtaacctctggaagccacaggaatcagggcctcaacattgtattctatgtatatttgtattgtttgaagtttttacaatagcatgcatgcatgtattgcttatgtaattttctaagattttaatttttataagtacacatggcttctcctttatttgaaatgtgtactagatgatcaaagcattcttctaggagaaaataagtttttgtggccaaaaaaattctttaagttatttttggtttttagggggttgcctccatgtcacagcttaatcatcagacacattaaccttgcagctcagcacgccctctgtttgtcagcagaccttcctcgcccatagggtaagcaatagaaagcttataggtatcagtttattttgcctgggatcagggtctggattgtgaagtgggacatgttgataaacctcttctccaaaattaggtcaatgggcatttggctcatattaccagaatgctggctggccatgtacagcctgtctccgagagaggctctaatgtggcccccacattagaacaacctgccaatgaccacattagaacctccattgttaaaatgcaggttcctgagccccatcccagatctgaatcacaatctccaagcatcagccccaagaacctgaattttgttgttacatgcagataaagtacgagaaccacttcctccatgggtgaactgaacttaccaaaatagtcagtcccgaggggcagagatggcgtaggtgccagttcttctttctcatcctagatgctcagagtcaaattcttggctcagcaatagacaagtgatttcactgtgggaagacaattcagagccctgttccaggctcctcacattgattctctctgtcttcttccactcctctttgtcatctttgatgtccccttgtgagctacgaaaagactttctgggacacgacaggataaaaaaataaataagtgcaagcagccattcattaaacgtttagccaggatgctgctttaactgcatcccatcatatctcattaatcttcacaccagtcctgagatcaggtactattattaacccgattttacagatgtgaggaactgaggcttaacgaaggtaagtaacttgcaggtgcgggtatccagctctctaactccagagcccatgctcttaaaaccctattacttgtccctggtggaggtgaacactgggggccctttcatataggactagccctcgggctgcaatctgagcggaaaagggaggatgagggcatacttcgaagcttcttttgcataactggcgctggatttttactgagactttacgttacagttttttttttttaattttcaaggtgcttttacgaacacatgaataaaatatttgtgtcattttgaaccttacttgtcttattttatgcatgtatttatttatgggggggcacaaggactcatctgtggtggtgcagccactgtaaataaattagtgaaactacttcacgtcaatttctgttcagtacactttagtgatggatcggaggaaattaatacatgtttacaaaaagcccctcccccagttgttacatatgcctcagagataccagttgtgaaaagtgcaggtgcacttacacacatacgcacacacaccccacaaatggtatcatacgaaaaaacatacctgcaatctgctttgtccacttaattgtatatcttggatacagaacttgtttcactggaaggctaaaaggcaaagtctggggaggcctagaggacacaggggatgggaggaggcgctctgagctggatgtaaggtctccacccacggccagagcacaaggtcggataaccagtgggcctgccggcttggctgcctgggccctcccctgccgagacaaacggctggagggaggaagtgtgcggctgggaagctccgctgctctggcccgggtttcccatttcccccttcccgcgctgagacggcgaggaaagttagcccggaaatctgcgcccgcctaaaacccggcctggtcccagccaccgccccaggaacttcccccaccgcaggggcggaggtcgagagcagggatggagaagtggacctgcgcgggtggactccggggcgcgggtggactccggggcgcggggggactccgaggagcgggtggactgtggggcgcgggtaccgtctcgcagcgacctctgtcggcggctctggggatggcccgcatctgtctgcgtgtacctggtatacgtgcaggtacatgttcctgttcacgtgcagactgggcgggggatgggggggtccacaccggtgtacacctttgcatacctcttagcaacttgaaattccaccacgagagatatctttattccgctattcctgtgcatctgcacggagcccctagggccatagatttgtgtgcaaatgaaatgaggatgtagtctgggtgcccaagggggggtgccttgagtgtggttgtctgtatgcctccctgagggtatttcactttctgctcccatccgcccctatgagcgagtacctatgagcacaggatgtgcacatatttgagtcttattagtggtacacgcagttttatcatctccccaggtctgtgtctgtatgaaatgtgcatgggtgtgtgtgtgcacgcgtgtgttcccactcggggaatgtggggagaggtgcatggagccaagatgggtggtaaatagtatgtttctgaaattaaaggactaatgtggaggaaggcgccccagatgtactaaaccctttgcccttcatctcatcctctctgacttgggaagaaccaggattttgtttttaagcccttgggcatacagttgttccatcccgacatgaactcagcctcccgtctgaccgccccttggccttccttcttcctcgatctgtggaacccagggaatctgcctagtgctgtctccaagcaccttggccatgatgtaaacccagagaaattagcatctccatctccttccttattccccacccaaaagtcatttcctcttagttcattacctgggattttgatgtctatgttccctcctcgttattgatacacacacagagagagacaaacaaaaaaggaacttcttgaaattcccccagaaggttttgagagttgttttcaatgttgcaacaagtcagtttctagtttaagtttccatcagaaaggagtagagtatataagttccagtaccagcaacagcagcagaagaaacaacatctgtttcagggccattggactctccgtcctgcccagagcaaggtaagcacttcccaagcccctacctccctcccctccctgtgggcctgcagctgtccaggtgtagaaaccgttagtgtgctaccccagcagctggcaggagggagttggtggattcctggaagcatccctggtgagtcatctgctggaacattagtgaaaacttagtactctagggaccgatgtacagtgtccattttaaaagccacctaataataactgtatagcaagatctgtgtgtatgcatagtttgtggaaatgtttgttttatcttattttgaagtggtgtgtattgatgtataaaagtatattcctaaatgttaatgcccatcagttaaaggattgtatagagctaaagtgagtggtgcctgccttactattgaaatttttaaaaagcctttcgtgcattccttaaagtaattggattcataattataataatgttacaaatcagacttgctcccatatttgtgatggtcttggtcgtcagttgtgatatcaaccaaaatgacagctgggatccccattcttgtggattaactaactttggccccagttaaaaaatgaaaagctattattgcttcctaaagagtttttaaatctgtgagaagggggaaaaaaaggtttttttacttgcccaggtaaaattgtgtgcaacaacaatgtcattttaacaaagggattactaaaccccaggtgatgacccactttttcaaacaaggaattgcaagatactagatggaatgtgggtaacctcttagagtttagtttactggaatctgaaattgtatgatttccgtacattccttcatgctactaataagtcatggaatccctctgtgctggactctgggggtaaagtgcaaaacaagatagacatgatccatggcataagagagttcactcagtgtggcagagaagacaaacagtaaagaagagactgtattgttgccattgtagtaaatgctgtggaaggaggggagcaaatagtgggtcctgacttcatctaggcaccatgacacttcacgtgaattatgtcactaactccttaccacagtagcatgcccattttatagatcaggagtgtggggcttaaaggggccaagtgactcacccagagtcacacagttctagaagtctgcctggccctcaaactagggatctttgcatgtgccacccatgccatctgtgactatatctttttattctttaataataactcccttttctaattaaaggtaacaaacaaaacttaaaaaagagatgcccacccaagcgtcattggcatgctgatgttggcaccagtgttgggaagcccttagcatactccaggaagtaggagtgtgtaacgtggggtccctttgtccttcatgcaagggtttcaagagtttagaaaacctatgaaattgcacacacaaaaatgtgttttaatcatcaagactctcagacttaccatgctgagaaatgtgggctgagggatagcgctccctagtatcagctgatgggccagagagccaaaggaggagacccaccaccatcacctctcctggacagtgctctgtggtttcaaatgtaggtgatactaaaatgggagttgcttcttagaaccatggccggggttcccttgaccctgaagtgcagttcacctgagattgtcaaatgcatctgaggcatgcagaggaagtgctgggcacacagctagtgggaatacctcagcgtaagtggccaggagatgccaggaatctccactatttcccttccagtgtgccagcctctgggttttacaggcgcatgtaattgcagtacctctgtgcacatttccctactgcctagaatgactttcttgactatccatgatatataaaacacagataccgaattgttcccttacctcttcctctaggttcaagttaatatgttattggttgccttctataatatgttatctcattgcctttcccaacaagcctttgagataagtattaggtccattttatagacaaagagactgaggctcagcgagtaacttggccaacaagttgctcccactgctcaacagcaaatgagcggtgggaccaaaattcaagcctgtgtctgtttaacttcaagcctgtgaatgtactaaccggtgccctgtgccagctagtactttgctacagtcataacctagactgaagtgatagccatgcccctaaaactccatgctgtggtgacagcactgagcagtgtccaagaaggcttgacttctaggcctgtctctgccactcacaaactttataagggaataaagtacatagcaaggtccgcctagagttagtagcagttctgacaaagctgtaatttgtcaatattccgtcacccaacccaggaatgctcatttttaaggtatttgactgaaacagttgagcattgcccttcatatagtttaaaacagtggtttcagaaccactttcctccagaccatgggtgctctgcaaggtgaatggagttgtttcagaatgtttcaataatcatccctacctcattcgtaagtggcatgtaatttttgcaatcggaagattttcataaaccctggatactaacctagactggtttctatatcagatggtggcttatttaacataaaattatgcattttactatttcatggtggatatatcaatatgttgtggtcttttcccaatgaacactttgattttcaggggttctggaccctgaacatgggttaaaccagtggttctcaaggtgtggtcttagcgccagcagcatctgcttcccctggaaactttctagaaatgcatattctcaggccctcatgcctgctgaatcagacactctgggggtgggactcagccgtctgttgtagcagtgcttccaggttatcctgacagtcactcaaattttagaaccactaggttctctatatgggagagagtagtctttgaacttggaaaacaagagaagctaaacccctacagcaagggctggtgaccaggtcgttgccagaacctgaaagttcgcctctgtattaccgttcctgtccctaacccaagtccttcagttctgggtgctccagcacacactgctttgtgctgcagtgatacaaatgtatggctcatctccccagctggcggggaggcatttaacacactgacttaataaatatttattgagtaaaagtatttgctcctaggaagcgggatccaggtaagccctttttttctctctcaactgcttctagcccagtgctctttatgtagtaagcactaaataaacaactgctagatgttgatccagaaagtcacattccttctctaagctttaagtttctcatcttaaaaataagaggattgtatcagatggcttgccttaggtctctttcagctccagagccccaaataccctatggttctctatttagagatgttcttccccacagactgccatagaactcctgtaatttacttagtatttgcttgacagtatggagaagaaaggggagaatcaagattttatttaaaaaaaaagtagctagaatgtgtatatggttcacaaaggtaacaagaattattgacattctttcttctcttttttcttcctcttccttctcttttcctccttctcttccccctgcttctctcccttcttatagatgtgtcaccagcagttggtcatctcttggttttccctggtttttctggcatctcccctcgtggccatatgggaactgaagaaagatggtaaccagcctctcattattctctgtggaggccccacttctaagccaggactcttgggcagccactggtgggaaatcaaactgaaatgggcaaccatgcactgggtcctctagagaaagccatcactctgggaaaatgcaatgccatatctctcttttctactttgatggtatctatattgtttggttttcacattggatgacattggtacactatggtggggaaagacatatgatatatgatatggtggggaaagacatatgacatatgatattttccaatattactaaaaactgtttcacacaattaaaattccaaagtagaggatttgcaaagtataacaactgtgttcgtttctcattccaccacatgatactgccccctcagttggcactgtgatgacttacctctgaccaagcactttggaggaagcataggattcagactcacattgacttgggttcaagtcctaggtctgtcaatgactggttatgtgactttaagctgggtcacctctaatcctgaatttcctcaactgtaaactggatgttacaaagtggatgcctaccacgtgggttatttagtgggttaatgaatgcagaatacaactcgacagatagtaaagtgaaagtaaatgtcagctagtattactattttggttgtttaaaatatctttcatgattcaagagatactttttattatcccaatgatcagtaaaaattattagtagactaatagaatagttaatggtaaaataaggagttctgcccatccttctagtatctcacactcagtaaatgtgcattctgaccgttggctgtacctgaaagaccctcagatttttatcactgaagccaacatcataatgttggcgattactatctttaattgtataataataatagttaatgtttattgagtgcactgtctcacttaattctcacaagagccatatgaagtagagactgtctgtatcccattttacagatgttggaaactgaggccagagagattaagtaacttgcccaatgtcacatacctggtaagggtggaacagggacttgatcccaattctgtcttgcttcaaagctggtgcacttaaatttgtgaaaacgtttttacaaggacatgaagtaattttttcccaggtctttggagagctgaataagaggaaatggacataaattaaggatgaaaatatttcagctgatgatcagaaataatcttttgatattctagaaagtaccatcttgaaatgggtacctgaaagaaatctgggaccactcctctcttctcaagaattttaggaagacagaatccagccaccccttctccatgagaatttgagagatttagacactctcttaagtaaaggcaaaggcctgagccaggggtatatggcagatcccttccaaccctgggattgttagcgagctcaggaaccttggtcctggcatatttgaccccttagtgacttctgatttggtaaaccacagaaattccagaaaatcagtgtgagaaactctccgaggtgtgacttaggagggcagacgatgcagtgaggctaagtgccaggttcttgatgctcctcttcagctttcctcctgcagctgttttccctgctgttgagcaaacatcttctagggcttccgagcctcagttgggacaggaaagtaaccatgctcttcaggtgtcagggggacaaaaaaaaaaccaagaaaaagccaaaagtgccacatggttttacatcagcacagctaatcatttccccagagttggaccccaaatgcttttgacctcttatttttgttatccattcagtccttataatccaattgatgtaaagtgaaaactttatattctacaatgctttacatccagaggccaataacgagaaccaccatttataaagcatgtaagggcactgtgtatgagcttatataatccacatatccaccttctaaagcaagggctaatatttttctcattttaaagatgatgacactgaggcttacagtagttgaatgtcttgccaaaggccacaagactggagcaagggctagagctgcttctaaatccaggcctctgccactccaaaatgcaggctctcaaccactgtgactcataaacttgagcaggcatcagcaccatctggagagcttaagaaccatataactaaatccatcccaaggtttctgattcagcagctgagaatttgcatttctgatctattccaaggtgatgctgctgatggtgtttcatcgatcatgctttgggaactactacattaaacaattctattcaattaataatttatgcatggattaaaaaaatgaatgaagctttgctatgacacactctgaaatactatactaagccattcctcaaaggccagtttagacactagcattaggcatcccttgcaaagcccaagagacaaaaggtctgagctgtagcccttgtacttctgacttgctgtgaccatgcttagatcgttggcctcagtacgcttcttcattaaatgggaagactaagctctactggactgcttcataagagtgtaagatagctaaaaataataataataataataataatgcagagagaatgaaaatctccactggtgatttaaaacagagggaacgaaatccttaaatatccatggaaaattgttaagagagtttctctgtacagttggctgactcctcagtctataagtaacgataactaacaccgaatttactgtgtggcagacactgtgctaagtactttacgtgctttttttttttttcatttaatcctcagtcaaatgtaaggcagatactgttattattatcattttacagatgaggaaactgaggctcatgataatgaaataccttgttccaaatcccccagctggttagtggagacaggatgacagtcttggttcgttgttctcgacaccctgagcttttaaccactatgttactctgctgaatattgtgccctgccgtattctctatgaaactgaaattgtgctggaagtttctctcccccagacctttggcaaagagtcttgtgctgtttgcagtttttggtatattaaggtgtttccaatctgctaaataatcaaaggttactattaaaggcagccttccagtcaatgagtcgatggcagctataaaactctttgtttctcttttccatgaccttgagcccaagcagggtctcatgccttgagatcatctcagcaagcatttgccaaatacttgttgtaaacaaggttgtgtttaggcaatggggatgcccgaagggttaataaaacacagtcccagagttcctggagcttacagcctggttctccactttatgtgcattccagtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaaggtaattctatacccttggatagtatcaattttctctttcgctcataagagttaaaaacaacaacaacaacaaattgaaaagccaagtcatggtgagtgtaatgaattaacatcaagtctcttattgatgttaattgatgttaacctccattttcctttgctttcctggaccctttgggttatcaaccatcaaaatctcatattaagggagtttcatgatcagtctgaatgcttagcctcatgttttctttaaataatggtgatattatttaatggctaatggaaattaaccgatagtgtatcactctgcactggggtgatagccttcaaaaaatgaatgcctctgccaggcatgttaggtgtgtagtgtactctgcagaatcaacaccccactgggatactcccaatccttatggagctacccaagaggcaacgcatggaagaacttcaccctgtaccatctggtgatctgtgattcatcacaatcaaaacctttctgcaaaaaactcctaaatattgaatttttgtttttttcaaatccagaacccaaaaataagacctttctaagatgcgaggccaagaattattctggacgtttcacctgctggtggctgacgacaatcagtactgatttgacattcagtgtcaaaagcagcagagggtgagtgaaactgctctggtttctcagcatttttctagaactatttcattaagaaattaagggcaacctctcagtgacctatcagttaatgataatgggaaaagcaaagtcaaacccgtgttttttcaaccgcccttccttgtctacattgaagaaagaacatggagattttagccgattgcttgaataaatgtatgtgttggggcaggatattattgggaactgagaatagtctctgctgtgtttgaacccactcatccaaattgcctggccatgcttcctgaagcctcatagcaccaaagaaagggataaacggagaattcaaagctacaaatgacttgctgaaattgcaccttgagtcaaaaataaaaacaagagctccagggcgtagatcttaggggccctgaagcagactccaaaactcgatgaggcctcccgaaattttcccagggccacctcaactccttttacttctgctgacaccactaatctgaagttcgctgttggtccaatgcacctggactttccgtaagaaagcaacttccataaatacaagacctatgtgttaacccccatgtggcttactttaatcatcaccgaagcaaaccccaggtgatcatcctgactttaccattatttcactgagtaaattaagcattggggtctcactttttcatctttaaaaggaaaatgcttactaaagaaatgtttctccaagtgcataaagacataatcagcagaggaatggttaaataaaacatggtacactatactcttgcttaatgtgcagtcattgaagtggataacccaacccatatgttttgtcatggagagctccccataatatgttcagaggggaaaaggatggttacataatcatatgtatacaatttgatcctagttcataaaaataaaatctatatgtataagtaaaatatatatagtggatatatataatgtagagatgtatataacatggattatatatataatgtgtgtatacatatgtgtgtgtgtgtgtgtgtatatatatatatatatatataaaatgtgtatacaattatcttgaatattcattgaaaaagttctggccaggcacagtggctcacacctgaaatcctaactctttgggaggctgagacagaatgattgcttgaggccaggagttcaagaccagcctaggcaacacagtgagaccccatctcagaaaatattaaaaataaaaaaattaggtgggtgtggtggcacacacctgtagtcccagctacttgggaggcagagggaggggatcacttgagcctaggagtttgaggctacagtggggtctgattccaccacttcactccagcctgggtggcagagcaaaaccctgtctcttaaaaaaaaaaagagagagagagagagaaagaaaaagaaaaaggaaggtctggaaggatacaacaagctattattagtacttaaacctgtggagagcagttaaggatgaaggagacatacacttctttcctttatatggatctttatcatctttacttttataattagtgtgtactgatttgtgtattgattttataattaaaatgggaaaaaatgaatttaagtttttaacaagggggtttaataatcagagattctagatctaaaacaaacaaaaacttccatattcatttagtccagagacatgtaagtgctcttgaatttaagctttttctcctggggagggcagtttcttaccctctgggtagaaatcagcccagttggagaaactgtgtcctcagacaacagttgaggccttacctgccttactggctacaatcactaggaactctctccccaatgtgtaacacaggctaatttctgtctttgacttcagctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcagtgagttttggatgattatatgtgctccataaggaaagatactatttgtcacgtgttcacaatgccccatgcactgtggggtaggtggttgacaagcatcatctcttttattctgcatccaaaaacaaaatacgatgtagatactgttatctgcattttaaggaagaggaaattgagtcttagaaaagttaagcaacttgccccagatctcagatcttacagctagccgttcaaatccagatccactccactacagctgctctttactgcactttgattcagctgccagatagtttccatgatgaatcccagagcctaatcaagcataatattcatattcagaaccagggcttccttactaatggcaattattcccaaccaatccttccttagcatttgaaaagggacttctttcttagaatataaacccttccaaaatggacatctttttttttaattggcagatagggatttcaccataagtcatttcctttactatttattcattgaccaggcagcatgataaagtgtaatagaaccagagaacttgcttcaaaacttatggagggtttgtacttggtgggtggggtctagttcacatagggtggccaaggaaggcctctctgaggaggtgacatttagctgacaccaaaaggaaagatgtcagttgtgttaagagcagagggaagcatatgtgcgaagcacctgctaggagccgtgatctttgtgtggagcagtgccaggcctacagagcccaaccacacaccctagcatgtctctgcctcctcttatctagaagacctaattgaggaaggagtctttgtgaaactcactgctgtatccttcatgcacagtccagtggctggaacataatgggcgctcagtattcatggaataaacaagcaaattgagcatagagacaattgactgtaactgctccaagacatgtccgcaccaaaagctatgaaaagacaaaagaaagggcagtaaatagaaaatctatcatctcatccccagggagaggctcagcttagttccatgttcagtgcaaagtgagggattagcacagacagggtggtccttcaatgcatggcccataaccattaaagcagaggtcttctcactgtgcggtcccatctgattgttcagtgatgaggattctgagcatctctcagatcctgcaatacatgtggatctgagatgtggccattgataatgactgccttcccgaggcaccagcgtgagcacctgcggcagaggtgcctcacatttgccagccaggtgctcacagaagttaagtaactatccagtggactcacagctgatcaaaggtgcaagtgagatcataagccaaaaccactgaactccaaagccttattaggaaaataaagcatgtttatcctcttccacagtcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaaggtaagaagtgattcaggtgcagtatattccttggtcagttttacggaggcccaccataaagtgagaagatgaatgatgataataacaatgacatccatgtatcacttaacaacagggatacattctgagaaattcatctttaggcagctatatcattgtgcaaacatatatggtgtacccacacaaacctagatggtatagcctactacgcttctaggctttatggtatagcctattgctcctaggctgcaaacctgtacagcatgttcctgtactgaatactgtaggcaattacaacacaatggtttgtatatctaaacagaaaagatatagcaaaaatacaatattataacaatataggaccactggtcatatatgtgatccttctttgactgaaatgttattatgtgatgcataattacttttcttagcacttttctatgtgtctagagctgtgccaagggttttccatgtttatttcacttaatctacaaaattaacgcaacaaaggtagctgatgttattcttgtttttttacccccttttttgtggaaaagaggctttccttttttccagaaactgtggcaaggtaaagtaaagctgtagctgatgcaggaattttgtgtaggtgttagcagcactgccctcactacgtgctcattggacagtagcccaaccccaagaaaaggatggttggtagccagtagtattatcatcatttcacaagtgattgaagactcagagaggttaagtgactttaccaaggtcacccagctaggaaatgacataaccaagacataaactcaatctgccagacagaaaggccatgcacctaaccactccactacctctgatgttggtcattgatcttggcactcagaattagtcctgatagaggagacctgggctccagaagcctaaaattgttgtttcaactgagtgcatgtaatgaatgatagaacaggcaagagatatcgcccccaaaatggatagctcctggctgttccagatattataaaattattttactaaacagaatgtctacacttatagaggctaagatattggcttcccagcttcctcgccttacagcagaattcctttgcctgttgcaaggttccagaggcccttttgtaccgccccagactcctttcaccccacttttaaaatcactggacaaagccctaattcagcatagcatttagcatgtggtagaaattcagtgagctagttactctctgggaaaataattaggtagggaggctatcctggaatagatatttacctaaatattattttacatcttggcaagtactttccctatttaagatctgtatgactaataggtgatattgagtgcttcctatgtgctaaagacttgctaagagtttaacgtgatttttaccttgaactataattctatgaagtaggcattattgttatccctatttataagtgaggaaacagacacagagaacctaagacattttcctgaagttacacagctattaagtagcagtgccagaatttgaaggcaagttttctgatgaaatgatcaggatatggtatttctcaatatctcagggatggctagagcaaatctgtctctctctcaccatcagctcaggactgggtgagtggccatggggtcttgaggcaaggcaattgtgctagaaagatgaaagctgggccaaacgatttctccctcaagggcttacaaagtacaaaagctgcacctacatgtggagtgtctgccagtaggtggtgcaagttctatgcacacccctgtgaattgcaagcacagtgccctaagaccaagatgggcttgttttgggagagtatgcattgcagaaacaggctcagcttaccctgtgactatgttgccaaggggtcttcacagctttccttctcttttgcagaaagatagagtcttcacggacaagacctcagccacgttcatctgccgcaaaaatgccagcattagcgtgcgggcccaggaccgctactatagctcatcttggagcgaatgggcatctgtgccctgcagttaggtgagcaggccctcaaaggccagcccaggcctgcactctcagtgcacctggatgcagggatatgattgggggctgtgttggagaggaaagggggatggagtggccagcacccagttgccagaatcagaaacatacatttattcactaacagatatttatttggtgcctttgttatgtaggacactgtgctggccacagggatattgcaggaaagaaaacagaccggggttctggcctcctaaagagaaaggcaaagaaaagagagaggtagccaggaggcagagcatggaggacttgcaagcttgcaggactcagaatcttgttctgggggccccgggccctgaaacccactgaagggttttcagcaaggaagtaacacaatcagatattattttaagaaaaccctcaagaaagcctctggcaagcatggtgccagccaaattccaggccacataaggaaggcctgggccttctggcatgaaatccctgaaacccagttgcccaggatcatatgttgtgagaaataagaagagacattgctgttacaatgtcaccccacatcaacttttggcattctcttccaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccatgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatcatattttgggcattctcagctgatttgagtactctgcttgcaagtctaccaggggtgcattttttcccctatcatttaagcattgccctttcttgaagtgatcccattccaaattttgcagagttgctctttccccttatagtatttccaaagtcagtgtcttcctgagctcaggggatgtccctgtaatctgacaaggaaggatcctttgcaagggcactgaactgcattgtgccttttttaggggtggaagctctcacttattccaccctctatcctggaatcgactctactggtatcccaagaatcatgaaataaaactctaacctggtacagccatggacatctcagctcttaggtccagctctagtatttattgagagtttgccgtatatatggacatgtgctagccctcagggttgggaagtttcaaaaagccttgcattgtgtctcccaaacagtgcccactcctaacactgcttataaggcaggatgaaaagttaacttcactatcattacacgctaaaatgttcaggatatatggtagcctggggtgagaatgaaaaagaaggatctgtgtaacccagcaccatccaggaagactcatcagagaagagagggtgccaactttgggctaaagaatgggcagggcctgcaaattccccttggtgcttcccatggaaggaggagatggtgggatcagagggaatgcagtccaatttcctgctatcccaaaaatccaagtgtgcacattcaggcttccttgcaatggcagggtaattataataggggtgtttgtttacattcctgattttcagtgtcccctggagccctatgccactctgctcctggcctggaggaatggtgggtggcttctgtcattctttgccaacctttggagcatatggtcccgtgttataagcccacacttgacagcatatggttgttaataacaagtgtttgtccccctacagggtctttcatctgcagttaccaaagtacttaacggacatttaatgaacaacactaaccagatttttaaaaaataaataactaatcacatttcataagcactgagaactgggacctttccccaaatttctggccagcctggggcagaggtgagatgttctggctcccaccatgcccagtgcttttgcgacatgacctcttagcattcgattaatttcagtgcatgcaatgcagagtttttcttctttaaagatagtctccaggactgtcctttttattgtaaatctagccactacaaaatgtactaaatgtctaagccaaagatcttaggactgggaatcagaggagcagactccagtcccaactatggttacataacagacttgtgaccttgagcagggtgttggaaacagcctgctggttttccaatcaatactcattcccaactgttttctccccgatgccctcttcagctctaaatgttggtaagtttagcgaccactttttcagccacctttgttgcccagcaaagccaaaacactgagttctggccaatgagatataagaaaattctgctgggagggttgctgagaagctttggcttttctgatgaaagacagagccatgtctagcatcaccctttccttccatcctcctctcttgagcagaaaaaaatctcgagaagcttcagaggacaccttgtgcccagtatgaaagccatcatgcaaaaactcaagctagagacttcaggctaggcgctgtggctcatgcctgtaatcccagcactttgggagactgaggtgggcagatcacctaaggtcaggagttcaagaccagcctggtcaacatggtgaaaccccgtctctaccaaaaaagtacaaacattagctgggcatggtggtacactcctataatcccagctacttgggaggctgaggcaggagaatcacttgaacttaggaggcagagtttgcagtaagcagagatcacacaattgcactccagcctgggcaacagagtgagactttgtctcaaaaaaaaaaaaaagaaagaaaaagaaaaagaaaagaaaagaaaaaagccagactccagatcctcatggcatcatggagcagctgaaccaaccactgtatctacctaccccagatttcttgacatgtgagagagacagatccatatttgtttcttttttttattgtggtgaaatattcataacataaaatgtaacattttaaccattttcaggtgtacagttcagtggcattaaatacattcatattgttgtgcaaccatcactccacccatcaccagaactatttaatcagacccccatctatgagaggctgctggccaagtcagaaaaaggacccatgccagcacaggaagaaacctggggtttggtgtcagaaaacctggttctgcccctcacagctggcatgggcctggtgaagacacggagtactcgatttccagagacatcaggtggggctttggtgataccctgcttcgctgacctctgtgaggtgtaaaacaagtgaggacataaacctgcaggccccctcctgaaatcttcaagtgtcatacccttaggagtccgtctccccactcccatgttcaagaagaaagtgagaaaactaagcaccaaaggcagccatagaagctgcctcacgaggtccctaacaaccctgtgcaggaggaattctcatcccattattacagataaggaaactatggccaaggtccctgttccaagggcagcctgagcatcagcaggactcacctgaaggcggggagagattggggatcccacaggaaagcacctctactgtcctttcattcagtatttttggagtccctggtaccgtctctgtccttggcaccatcctcaactttttggatacaggggtgagtgagcccctgccttcccatggtttctcatctccagaggaccaaatgcttggaattctaagcactggaggccacttcctaaggatcaagggcactattgcatgaaataaataattggtttaatgtgatggtcaccgtgcctggctcacaggaagcactcagtgaatggcagctatgtccactgactagctgtgatcttgaacaagttatttaacatcttcgagcctcagttttctcatccttcaaatggaatgatagtacctacctcatagtgtggttgtgaggatcaaatgaaataatgttcaaaaattgctttaaaatgtacctgatccaataagtaaaagcttactgtaaagtaaaatgtacctgatctaataactaaaagcttattgttattagttttattgtgctatttagaacctgaaagaagcataattctggaccctgtgcttcttgcaaggtttaggggatgaaggggtggtttttacctggccttggtgtctctgagaaccgggttggcatggaggaatcattaatcagccagtggggatgagaaagctggtccagtctgttagcatatttaaaagcctctccggtgtaaaatccctttcttgtaaataaaatcgccaaaacgtccccacatgggggtatcaagatgccgtgaaccccgttcttgctttcagggcttgtacagcctggtgagaaacagaaaagggaaatggtggtgaatataataaaatataacctggctactagctgagttaaaggtatgtgcaccataaatatttatttttacaaaggtttccatctcccgggaggagccctttcattccctttcaccttctctggatgtaatgaatttggcataatcctaccaattcaccttacctataaatcagactttaatcatctccgtttcatttcagtgtagtccttcttctagggcggcgtttgggagcaaaatatatctggacaagactttctccagagggtcatattataccaaggaaatgaattccctgtctcaagctcataaaccgcaaaaataaagccagcattctggctgaaggcggaggaaaccagacgcgcacacagaaaaccctccttctgcgggaagcgctgggcggagctgatttgcatttaccttcacgcaggcctgggttccgcaggaggcctagagcgttccggcagcgcgcccgcccgcccgccgcggtcgtgcgcagccactcaacccggtggatgctagcgtgtgacgggctgcagggccctgccgctgctcactaagctcccccgtctcctttcataaggagcaccatcccttcacttctatccatcaggctgcttgcaaaaggagctaacccgggcatgtgggattccaaggaactgaacattccgccagtggctctggggtttggtgaagagggaaagtcgagggacaaatcttgggtaagccacagtgttcggtgagcttcctccttcccacgaccaacatacagataggtgtaatgaagttaaaatgccagcaagagaaacaacacctggaaggagtccagagcacaggggtgcgcacttgatcctgaagcaaggctcacacctgggctcaccacttaccagctttttgctcttaggcaattccttatctctttgtgtgtgtgtcctcacctctaaaacaagtatgctaatagtgccaccatctactgggtgctgtgggggttaaatgagtcaaggctcacaggacccagtgctccatcgcccaggctggagtgcagtggcacaatcaaagctcacggcagcttctaacctgcagcctcaaactcctgggctcaagcgattctcccgcctcaccctcccgcgattgtttttctcagagcaggccaacaaggagaggcaatcctaaagcccacttctttttccctccccatgaatatgaaggttgactttggacatgtacagaagccttccagtcctaactcagaaagctatgtccttccagccaccagccctttgctgggcatacagccagcacacagcagtgacatctccctggaatcacagcactcagagcaatgccctatttcagcaaattattgcatgggtttctgctcaaccttgtagaacatcctccagccatggcttgtccatttccctgaaactcctctttattgagtgtttggggtgtttaagggttaaccagcccaatggtcccccaacttgtttgagccagggtccctttgttcaaatggaaatcttaaatgcaattccaagatacacaggaattggggagtatggtggccaaaggggctttagttgcatctgcaacgttctaatttcttacaaggaaaatatatattttttgcataattaaaagttagttttttatgaagtcctatatataaagtaggcaaaagcagagctgctctggctggagcctcacacccactcattccctgtcccctattcaccactgagagccctaaggcctcttctcaacactcctaaattctgcagaacacagttttatagatgacaaaacagaaggacagagtttggtgccgtgcccaaacaccaggattaatgccagggctcaaacttgagcctgggtctcctgactcccattttggcagttcctgttcaaattcccagaagattgccaactaaagatactttcttttcaacttttcattctgaattaatttcagaattagaaaaatatggccaaaatagttcacagaagtcccatattactatcaccgggtttctctaatgttaacataaacttggtatagttatccaaaacagtaaaattaacattgatcaatactactacctaatagatagaccttattcaaattttgctaatttttccaccaatgtgcttttcctcgtccaggatacaatctaagacacaacactgaatttagtttcatgccctataatcacctcaagtctgggaaggttccttggtcttccttaaccacgcattaccttgacacatttgaagagctaggagcagttattttgtaaaatgtccctcaagtgacatttgtctcatgtttcttcatgattaaatttgggttctacatttttgtcaagcatcctacagcagtaatactgtgcccttctcagtgaatctcatcaggaggggcatgaaatcaatgtctctcagtactggtgaaattaactttgatcactttgtttaggttgtgtctgtccaccagtgttctcccctgtagtactctttttttcttttggaattaatatatcttgtggagagaccctttaagactatgttagtaccctttttctcatcatacttctaccaacagattttgtcatacgtagatgatacttgcttgcaagcaacagtaatttcgcctaatggtgattttctatttctatccttctttctatgtttattagtttgaattctactgtaaacaagaattctttattcttcctatattctttttagtaaaacattcctaacttttgatgttatcagagaccatcatgttgactccacagaacccttggtatctgactctcgggtctgcccggttttgaggtattcacttctgtgccaccataaagaaaaatgccttctttattttgcatttaaaccttatgattttagttgccattaatagaatttttgggagaggagtgtgctaaatgctttgcagggtgaagaggatgttttaattattcaagagaactgcttttattcaattcgggtgtacccacttacacataaaaattaatgctaaatagatgtaatttccatctattcattaaaacaaaccccaaagcagtccagaaatccttagtagcctaatgttattcttggcacttgaaaacaaaactacttttcttaaagaaggaaaaccataacctgtgttttataaaacacttattctcaccaatggtggccttcttgctccttttttccaagtaccctccctgtttccttctcctaagcaaccattcactcaacactattttactgagaatctactgtgtgccggcctcttttctaaattctggggccaaaccagcagacaaaacagacctgaactcccccgttttgagcttccagtttattcaggggagatagactacaaattctttaagtggtagctgctttgcagtaacattaagaatcacaggggcagaggaacctctaatttagatagcatgaacaaggaaagcccctcagaagaggtaggtgtggtgagatttgaacagagaacagaaagaagtgagggagaagctgtgtgccttggggcaggaggcgcatttcaggaaaggagaagcaagtgcaaggttctgttttaggggcaatgattgggctgcatttgctagtgggaggggttgttgtgtgtccccttttgctgtatatatacagccttcttttgctaagtcttgcatttttagtaccttcccatctacttctctctgcttaattttttcaacatgtagttttgaatatatttccttgaggtctgatatagggatggatagatagatagatataaatattaatataatgtatatatagagtctgactccttttttttgatgtgtaactgtggacagcttttaagccttgcctctctctcttacctctctgcaccacacccacacctgggcaagctgctcagaaagcctgggtgtgccctcctttggtatagcatctgaaccaaatttggggtaaagattcacaacaatatccatctgtgctggtcagtacaataggcgccagccacagctattgagcacctcagttggaaacatggcgggatgtgctgtacatgcaaaatacactctgggtctcaaagacaatatgaaagaggccggacaacatatagaccctgtctctacaaaaaacaaaacaattagcccagcatggtggtgcacatctgttgtcctagctacttgggaggccgaggctggaggattgcttaagcctgagaggtccgagctgcagtgagctatcatcacaccagtatactccgacctgggtgaccctgtctctaaaataaaataaaataataaaaaacaaagatagtatgaaagaatgtaaaatatcctattaataatttttaagttgctgggcacggtggctcacagctgtaatcccagcactttgggaggccgaggtgggtggatcacctgaggtcaggagttcgagaccagcctagccaacatggtgaaaccctgtctctaataaaaaatacaaaaattagccgggcatggtggcaggtgcctgtaaactcagctactcgggaggctgaggcaggagaattgctggaacccgggaggcagaggttgccatgagccaagatcatgccattgcactctagcccgggccaacaacagcaagactccgtctcaaaaataataataataataataatttttaagttgattgtatgataaaataatatatatcaagtttaaagtattattaacattaatttcacctttttaaaccttttttaatgggagtacagtatttttgttttgtagagctgggggttctcactatgttgctcaggttggtcttgacctcctaggctcaagcagtcctcccgtcttggcctcccaaagtgctgggattatgggcaagagcactgcacctggctacattaaattttttaattaaatatatgactcatatttgtcattcaccttctacttctgttagatagcattaacatataccaaagtagtgacaatgactatgtcttagtttgttacttttttttaattccttcttttggattctctgtattctctgagcatgtatttaaaaataaaaagacatttcttggagttgttgttggtggagataggaaggccttttggaggatctgagaaggaaaggtctccctacccaaaaagtccagaaagggaaaacattttccaatcagccatgattctgaaactgacatctgccctctctccactgtttaattaatctaaacttgatctgaggctgactccataccttgagtccctatgtaatgaactgcatgcaacctaacttggtatgaactgactgaaagctaatttaatatatttttgtagctaatagctgagcctcagcagtaaaacacagcagcaaacctccaatcaattataggttaccaactgatcagaccatgctcaaataaagcaaacacctagctgtaaccaaccaagctgtctctgtacctcacttccattttctgttcatttgctgtcagcccatatcggggagcagagttctctcaacttctgctggttctgagagctgccctattgacaagtcattcttcgctcaattaaatttggttaaatttaacttatctaaagatttactttcaacactgcacatatactgttagagacaagcagcctctctctacaagcgttggaataaatgactttcttatggtgactctggagtttgcaaatgcattggtgtgccttggcttgcaagccctggctcgttagcactgatatgctgctgtcataggaagcccaaggtgtggccgactacgactttcctgtgtagtctagggttgccatttgtgcttaatccaatccatatctactctctacaagccctcagtgtcccagatccttgtccacaaacctggaggaccaagctggggatggctgtccaagcatggatcaagctgctttgcagactgctttgcagggtaatgttttggaacaaactgtacagacttagtcatgcaaaatgttattgtattgaagaggtcagaattcagagcacacttggctaatccagcaactgaattttactactactgactctgatgaacagaaaacaactctgccacctgtacacaggcagtcaactctttctaccagaagaggaatggacagtaagagaaggcagaacagggggaagaaatcaaatggatttaactagatcatcacataaaaactgcaaatgtcctatcatttttcagaaagattcaatgtctgctttcaaaggattttactatatgtatcttctttacacaagtacattttaaaatttaagtccgagtgatttcaattctgtaaattttgaaatttcactgagtaagaaaaatactgactactgaccctcaagaggcaagtctacacaaataggcaaatttgtaagtttactgttggggctctgaaaatgataccccaaagtttggggctttcatgcagagtgctttgaactaagggagaaccaaaaagcctccctgaacttctgccctgctgtctctcacccctgtttcaaaagcacagggaagggtggtctctgaacttgcctcgtctgcctaaagatagatcttccaaaaaggcactcaattgtcatgagtttcctccccaggaatctcattaattaggaaaaattaactgtatcacaggaggagaacagactgaaggtaattgccaagcccagacattatcacaaactatcacctgttctgaggggtgctccaagacaacctttattactctggagactgtttatctgcataacaagacaacttttattcaccatgcatttcctctcctttccctcccataatttgtgtcatgccccacccccaaattaagctccaagccccaattcctttctgtagctcaggatgctatataaactttaatcatctagcccttctttgagtctcatcttttgtgagattcccatgcctatgcacataattaaaattgttttttcctgttaatctatctactgtctatttacttcccagactcaatgatcaaaccttaagagggtagagagaaaggttttctcccttacattacattccacctaagatccacaaaaagagaaaatttcacttttaggtaatgaaaaagttacccaaaatataaaaaccctcatatttgactttactcttctaactccgcaaactgaagccaccactagctactacaatttgaccaccaaggtatacatttttctaacagctgtaatgaggtatagttcacatactctacaagtgactcttttaaggtgtctaattcaacaggttttatacacttacagagttgtgctcccatcaccacaataaattctggaatattttcaataccccaaaaagaaacacagcaccccttcaccatcaacacctgatatggtttgcatatttgtccctccaaatctcatgttgaaatttgatccccaatgttggaagtgggacctgatgagagctgtttgggtcatgggagtggaaccctcatgaatggcttgagccatcctcttggtgatgagtgagttcttgctctattagtttacgtgacagctaattgtttaaaggagcctggggcctctcccctctctctcacttcctctcttgccatatgatatgccagctccctctttgcattccaccataactgtaagctccctgaggcctcaccagaagcagagcggatgctgacaccgtgcttcctgaacagccgcagaactgtgagctaaataaacctctcttctttacaaactactcagccttaggtattcctttatagtaatgcaaaacagactaacacaaatcccaatcccagtatccctccttctctgcatgttcctaggcaaccacaatctactttctgtctctgtgggtttgtctattctggacattttatataaattgaattatataatatgtggtcctttgtgactttcttcttttacttagcataatattttcaaggttcatacatgttgcagcatgtatcagtacttcattccttttgttcctgagcaatatttgattgcattgatatgccacattttatttacccgtttatcaattgatggacatttgggttgtttccagttttttactattatggctaatgctgctatgaatattcatgtacctaagtgtaattttaaatttaagtaattcttgcctaaggcttaggatacatcccccccagaaaatgagaataaagcaaagttttgcaaagcagcaaagcagaactttactgtatcagtgattgccactcttaagtcaccttttcccatggaagatagtccttaacagcctgatttaggaacatcaaaagaggtccgtctaaaaatgttgtgttaagcagattcaaacatgttttgttttgttttgttttgttttgttttgttttgttttgttttgttttgtttgagaccgagtttcactcttgttgcccaggctggaatgcaatggcgtgatctcggctcactgcaacctccacctccagggttcaagtgattctcctgcctcatgttgaatacagtgagttctaaatttctcttcaaagaatcagtatgtcagtatgttcagttctttgttctccattttaaagtttaacttcctcattctcctcgcccatagtttcagtaaacaactttttccaccagttctaatcagcagttcacatctgttcccctggtcacctgctctgtcctgagtcacccctggtcatctgttccatctgagtcatccctggtcacctgctctgacctgaatcatcctgagttctcttttctgtaactgcccttcccaccaaactactcaccccgccactccgacttgttctccttctctctttaaaatagccaatcagaattatcttagactgtgtggtccaaccctagccaataagggaacgacatagcagtaggggctacctgtgtcaggaataaaaagcccttcccctcccttgttcaggtgtgctctcaccattgctccatccacgagtcacacttttctatagaagtaaaattgccttgctgagaaaattaaatttatgtttgagtgctatttcttttgtggcgccaaaagtttatttataacactcagcttcccaagtagctggaattacaggcatgcaccactgtgcccagctaattttgtatttttagtagagataaggtttcatcgtgttggtcacgctggtctcgaactcctgacctcaagtgatccgcctgccttgacctcccaaagtgctggaattacagacatgagccactacacccagcctcaaacacacatatttattgcatgtctaatgtagcagagaaaaaataattttttttctacttttcatgatttttagctgatacaactaaaattcctataacaaaagacagattaaccacagaaaaacaaacatgtatgtctcatttataccacgggagatacacagggaaaatgagtaattctctaagaggtggtttgaattccatctaccgaaacaaaaaaaagggagcggggtggggaaggtccagctttgccaagatggccaggcaaaacaccataaaacagcattaggtttgttatgcagatttaagtcagtgtcttctccattggtaggcatgtataatgatgtacagtcatccttctcttcctggtgcagagaggaaaacacccttaaattggagatttcctttgtaaatgcaaattttccttacaaaagtgtaatttctactcttgttttcagagcttctcctaggtctgctgtttcttaaaataattagatcaacataatccttatgctaaaggagcatattttggggtgatatattctagtccagtacactcatatattggggtgatgtgtcttgaacctcatcactaataaataaaaagtgctatttgtagttggtaaataattgtaaaatattttttaaaaattttctatatattttttgtacctcttggtcttcctctgcatccctacccccattcagtcattcattgcctcaaggaatagataactcaaagaatagcagagaacaaaggcttttggatttgttattgaactgaacttgggtctgctcacttggcacagcaaagccaaatgctgacatcaagatttgctgtgagataaacagctgtaggtaaacagcagcaacaaaaacaaaataaattattcattaattataaaaaaagatgttcaatgaga

SEQ ID NO: 19 - DNA, 37720 bp, Homo sapiens
agagagaatctctcagcctgtgatttctcccatgagagaaactgagaacataggaagtgagtacctggcttccccagtcatgtggaatgctgcccaagagggctgcacctttcttttgccactcaaagtaccatggtggttggtagagctcagcagttaggagagattgcgagtagagaagagaagagactcatagcaaccaatactcagtattcagaaaagggatgcagtttttattaactgcttcatgaacttcatcaggaagcttgtccaaaactacttgggacaacacacatgcagactccccagctggcccacaggcctctgcaatgttatgcatgcctcacatatctcccctacccccatgccagcttcccacttgtggcctcatggactgaaagtgtgcatctcagcaggaggtttacaagtacatgcagacagacagcctgacttggcaagataggaaaaaagtacacaaagttgagtatttcagggcaccatcttgggaaaacaaatgagaggatctcagcacctggcttggctctgcaggaccaagagaaggcagagaatcttaataattcaccccccaagacagaacaagaggtgtggagggggaatattcatataaaagttaggagagagtctcagaatccctagtcagactgactggtgaaggtgtttctctctcaaagctggtcagtaaagactagaggaggtaattgcttcttcaaatgcaaagacagcaaggtaacacttcagggaacacagaaaataattgtgacactaacaaaggaccatgacaccaacaaaggaacaatttttcagtaaccactcccaaaggaatggagatctatgaattccctgaaaaagaatttgatataattgtttaaaggaagctcagtgagctagaagagaataacccttctctttgttgagatagataactcaacattatcagaaaaacaacacatgaacaaaacaatgaactcaacaaaaagaaatgattaaaaaaacaattctggaactgaacaatacaatgaatgaagtgaaaaatgcaatagaggccttcaacagtagactcaatcaagcagaaaataaagaatctatgaactcaaagacaggtcatttgaaattatcctgtcacaaaagaaaaaagaatgagaaagagaaaagagagcctacagaatttgtgggatgccattaagagaattgctagagatgctccttgacttagaatggggttatgtctcaataaacccatcataagttgaaaatatcataagtcaaaaatgcatttaatacacctgacctacctaacatcatagctcagtcagtctatcttaaacatgctcagaacacttacagtagcctaaacctgggcaaaattatctaacaaaaagcctattttataataaagtgctgaatatctcatgtcatttattaaatattgtactgaaagtgaaaaacagaatgattatatgggtacttgaagcatggtttctactgaatgtgtatcgctttcatggcatcataaagttgaaaagttttaagttggaccactgtaagttgagaaccatgtgttccataagtcttatggaaggaggaggagaggagaaaagggcaaaaaacttatttaaagaaataatggctgaaaactttccaaatgtggggagagatatggacgtccaggtatatgaagctcaaatgtcttcaaacaggttcaacccaaagagtacttcatcaaacctgttgcaataaaaacttcaaaaatcaaagacaaagaaagaattttgagagcagcaagagaaaagaaactcaccaaatacaaaagaacactgtaagatcatcagaggacttctcagcagaaaccttacaggccaggagagagtaggatgatatagtcaaagtgttggggaaaaaaaggcaaccaagaacactttagctagaaaagctatcatttagaaatgaagaagagataaagtctttctcagacaaacaaaaactggggaagttcattaccactagacctgccttaccagaaatgctaaagggagtttttcaaattgaaataaaaggctgctaactaataaaatgcaaacatatgacagtataaagcccaccggtaaaggtaagtatatagccaaattcacaatattctaatattgtaatatcaagatgtgtaaattatttttaattctagcataaaggtcaaaagacaaaagtcttaaaataactatagctacaataacttgctaatagatacacaatataagaagatgtaaattatgaaatcaaatacattaaatggggaggggaagtatactttttgtatgcattcaaagttaagttgttattggcttaaataggctcttatgtctcattgtgaccctgaagcaaaaatctgtagttaatacacaaaagatacaaaggaattaaagcacactactacagaaaataatcaaattataaaggaaaacagcaagatagttaatatcccaaatgtgtaaggaactcatagaacacaataccaaaaaacaaataacccaattaaaaaatgagtaaaggaccagaatggtcatttttccaaagaaggcatacatatggtcaacatgtatatgaaaagatgctcaacatcactaatcatcagggacatgcaaatcaaaactataataaaatattacttcatacctgttagaatggctgttatcaaaaaaacaaaagataaatgttggcaagggtgtgtaagaaagggtactattgcacactgttggtgggaaagaaaattgatacagtcattgtggaaaacagaatggaagtctctcaaaaaaattaaaagtattattaacatatgatccagcaattacacctctgggtatatgtccaaaggaagtaaaatttctaacttgaagagatatctgcactcccctgtttattgtagcattattcacaatagccaagatacggaaatagcctaagaatccgtcaacagatgaaagactaaagaaaatgtggtatatgtacacaatggaatgttatttggcatttaaaaagaaggaaatcctgctatttgtgataccatggatgaaccaggaggacgttatgctaagtgaaataagacaaacagaaatacaaacactgcctgatctcacttatatgtaaaatctaaaaaaaaagttgaactcatattaacagaaagtagaatggtgactatcagaaactggagtgtggggagaaagagatgttgttcaaaaggtacaaatgtagtttgtacctatagttagaaatgtattttatatttgaaatttgccaggagagtagacctcaagcgttccacctccaaaaaggtcactatgtgagggctgctaattagcttgcttgtggtgatcattttacaaagtatatgtatatcaaaacatcatcttgtacaccttaaatatatacagtttttatttgccaatcgcacttcaacaaagctgggagaaaaactcgttccttttctataccatcctcttattgtttcatagagataatgttttatctctatgaagaaaatactgacttattgtttgattgtttgttttgagaccaagtctcgctctgtcgcccaggctggtgtgcagtggcgcgatctcggctcaccgcaagctctgcctcctgagttcacgccattctcctgcctcagcctcctgagtagctgggactacaggtgcccgccaccatgcctggctaattttttgtatttttagtagagacagggtttcaccgtgttagccaggatggtctcaatctcctgacctcgcgatctgcctgccttggcctcccaaagtgaatactgacatattttttaaatctttttttcactgcattgtctttgttttctcagtgttttattttccctgttaatttactttgctatctacatttcaagttagaagccatgcttagtctttgactacatcgaggggagcctttggctattctttgacttaagagagaaatactgaccagaaaggacccaccaccactccactggggatacccaaagggcagtaactgtgggattcttttcttgtgctggtctactttccctgagaacaacaatctaatgtgtagtgcggtgagcctggctgctgcattctgggagctgagcgctggaaggcagctggagtcctccacattcagtgtagcatctttcacttaatccccctgcttttaataaagcacatgtgatgttctctgtctctgtgcccagctgtgtcctgagcccagaatgtctcagtttcaactctctggagaggacacattctgttttctgctggattaaggaaaggcaagttgcctaattgctcaggctgggggatggactctgagaatccaattacttttttttttttttttttttttttttttttttttgagacacagtttcgctctgtcgcccaggctggagtgcagtggcgcgatctcggctcactgcaaactccgcctcctgggttcatgccattctcctgccttagcctcctgagtagctgggactacaggcgcccgccaccaagcccggctaattttttgtgtttttagtagagacagggtttcaccgtgttagccaggatagaatggtctcgatctcctgacctcgtgatccgcccgcctcggcctcccaaagtgctgggattacaggcgtgagccaccgcgcccagccccagttgctctttaatcagacttaaacccatcctcctatgttcagacccacctacaccttggcttgcagaggagctctgagcctccaattcctaagatgccagaggttctgtggggtgagctgacttgctctttatgattctctatcctcttgcctcccaggctttcctttggctctaagaagacccttatgagttctgcatcccagcttgcattctgttgacttctctcattttcccactttctttgtctttgtgggttttaccaccttcattcaatcaatgtcattttagctgagtttggggaagaaaccaaaattaatacatctgttcactctgtgacatttaaatggaagttttcagggcatcttgatttttttatattaaagcaccttgattttgtatgttatttatggtaatataaatatattttatttatttcccattataattagggaaaataaacattttaagggcttttctgagatcctattagctttgaccatatattttctaaaaaaagaagaaaaaaaaaagcaggtgacactaaaagtactatctctttctgtgacagcttttttacatgaaaactcagctcaggtcctggaaaaggctggcgattccttggcctgtagggccagttcggggttagagagagagagacagcagaaatgtgaaaagcagtggaaggaaaatgcaaagagaagaagggcttggccaagagagggtggggaagaagtcataccaacaaatcccactttcttcacagacctctccagagtgaggccctgccaagtagaataaataccatcataataaaacgctttccaaaacaaaaagagtttgagaggccaggcgatgtcaaatctaacggaaatcaatgccacaaaatcccaaccaaactcgagaattagggcagtcccacaaaacccattgcaatggtctctgacctcagagatatctaatgtggtcagtgggaagggtgggggcaccaggaatgggaccaaggagggtatggttatgttccctccctctctgtttctctaaggaaatttaatttctttctggggggttcttcttcctgccagaatccctaattcttggtgataccacaaaacctttgtctcatttcttttgttttgggttctctgcttttatgtgcttaggcagaagccgaatctgtaatccagttactgttattcacttgactgttgtttgaaaacgcaaatagatcagttctgaaccctattatagcccatccatgtcccctccagcatcgggcctgctggagtgcactgtaacccccttgcaggatgactcgctcttcacatttagcgggtgccatttgctgtctaatcctcttaccctccaatgtgttttagccactcgctgcagcataaaaacatgccatggtaactatgtacttaagagcctgtgttcttggcccttgattctgaaccaggaaaggaaaccaaataatgatcaactcataaaatgaaatgcccaaattagattttgttcttcccgtggcccagcccccaggattacggtgactaatgcagcaaatggagtgaagcacagagattttcagcccggcgcgggaagcacagctttggctgcatgtcagagggttagaaacccagggaaggaaactgcttggagcagtcctgcccagtgtcaaaacaacctggggatgattgcaaagcaccacagtggttttctcatccaattctatctgaaatcccctggagaaaatccacaatatgtgttttctagcctatagttgcttttaataatggtggtccaatttctaggaggtcgaacatgatacagccctggcttaataccttacagctgagttagcaatcaaagcagtggttactgtggcaggaagagggcagggcttgagaaggaacttctagagtgctggtatgattctgattttttatctgggtgctggttcctcaggggtattcagtttatgcaagtccatcaagctgtacatttatgacatgtgcacttttctacatgtgtattattcttcaataaagcatattttttaaacttacatcagtgacttttacctgtctcgagtcacagagccctttgaaaatctgataaaggatgtggccctctccccagaaaaactcacaaaacccctaactgtgcatctaatcttgggagtctcattgactccctgaaatcacgaacagaggagagaggacccatgagccccaagtgaagattccctgccttccaggattctctgctttctttgtaattttcactcccatttctactcaattgcagagagtcacccatggatcctgcagacaggctacctacccagcatttccacattgccagcctggctcatctctggtctcctttgtccccagttcatcctgggcacctctgtgtgtgtgcaccatgataggcttctgctcaaaacctacactgccttctcatggctaactggaataaatggaaacatctcctcccagatttgcagaagctccatcagaccccctttcttacctacccaaccccatctcatacccttctcccaccacaacctgcaatttcagtgaagttcccaatgtgttgattcattcctgcctttgaacattccacttttctcagccccaaatccctcttttttgtgtgtgaagctcataaaatactgtagctaccatcctgccttctctgagagccctttcttgactacaccaacaaaaagctctccctgtttgaaactctgtagcatttttctctctatccctgatttcattacatggtcttgtaccattcattcattcattcatttgttctttctatgagaactgtctgttattttgtttaaacgccattagtttttgattgctataaccaattaccacaaatgtagtggtttaaaacaacacaaatatattatctcacaattctctaggccagaagtccaacatgggtctcactgggctaaactcaaggtgtcaacagggctgtgtttctttctggaggctctaggagaaaatccatttccttgtcttttctacctgcaagaggctacctgaatgtcttagttcatggcccccttcctccatcttcaaggccggcaacagagggttgaattcctctcacatgacagcactctgccctcctcttgtacctctgtttctcccttttaacgacccttgtgattacagtgagtccatccaaacaatcccagataaccttattttaagatcagtagattagcaaccttaattccatctgcaacctaaattcctctttgccatgtaaggtaatatattaacaagtccgggggtggggggtgcaggggcgggtgcatttttctatcctaccacaaattctgcaggactttcttctctacatctgattttatcacatggtcctgtatgattcagtcattcattctatagtgaacatctgttgttttgtggtccggcatctatttaccccatttctaattataatatcccaaacttatccctgggagtcactacatcccgcactctcaggtaacatgtaaggttaccgtacacgtactccgtggagaaaaatcccacctcaagtccagctttggtcacagtgactctttcagtgatgggcatgtgacccagtgagaatcacatattggtggaactggtgggagagaggcatatgttctttgcctttgtaggtgaattggaaagatgagactctggaagtgccaagaacaccatgggaagcctggaaatgaaacccacactggaaaaggcagatctgacagaatattaatgccatcatttgagtcccctaaatcaaatcacgactgaaatcagaccaacctctgggcttttcagttatgagatttataaatctcttttttaattaaaccaggttatatctgtcacttacaacagaaagagttctaagtgaaacacattcctttattcactcccttattcaacaggttcaccctgcctgcctacatttgtatcaggcactgtgaataggagatacagtcatgaaacagacagacatagtctctgccctcatggaagttagacataaagtgggaagactgacaaaagactgacacacttcaatataatattgctattatgatggcaattatgaaagcattcgcatagacagtttacctaaaatctggggtcagggaagcaattaagctgacgtaataaggtgaatacgagttcaccaggctaaggtaggagagaggtggtgataaattgtgtttcagacaaaggaaagagtatacgaagaggctagaaggcaagagatctctacttttttttccaactctctagttgcctctacaaccagaacataaactcctcagagctgtgttttgaattctttctacattgggaacaatacctagtatagaggacttgctcaagaaaaaagtctgttgaccaacgactatctgtactaatatctaaggctagtttaagccctcattttccttttcttcagtggcaggttgagactttgcctatctagatatagggtaatataatgataacaacagtgaaaacaggaacagtatcaatcaatgctaaacatctcttgagcccttaccatatatcaggcactattctaagcagtatatatatatatatatatatatatatatatatgcagtttatttatatatatatatgcagtttatttatatatataagcagtttatatatatataagcagtttatatatatataagcagtttatatatatataagcagtttatatatatataagcagtatatatatacaagcagtatacatatatataaatatatatatatatatatataaaacacacacatatatatatttagaaataaggtcttgccttgttgcccaggctgatcttgaactcctggcctcaagcaattctcctatctaggcctcccaaagtgctggggttacaagcatgagccactgtgctcagccctacatgcattatttaatcctcactaccctttgaggtagttgtcattattattattattactattgccattttacacatgaaaatactaaagccaaaaaagataagcaatttgcggagtatggtggatacttctgattgactaactgatagtcattctccctgtcttctccttgctagaagaacctcagttttgttcagaggatcgtgtgttgcaggggagtggagtcctaccctaggcccagggggacgtcataattggcttaagtcaatggtaatcccattcgcattggtcatgattatgcatatgagacacaattgtacacaagaagaaatgaaaagaagtctgctaggaatccttgcagactaaaaggagatacatgagagagactttctttctgtctctggacattgtcatctgtctggagtacctagaactgcagcagtcttcatagaatcatgagagtaaggtaggagaatagggtctagagacagggagcttaagagcaactcatggctctcttcttagaattgaaccaaaaggaaaaccccacctctccatgcccaggtgaaaatgggctggaggcccctccctcagcaaaactcctttccccgtcaacaaataggaaatgcctctgattggccatgagcccagcctttacctagccctttgaatggccacaggcaaagccttcatttgcataggggctctagcctctgattggtcacaggccaattcttcattcgcatagggtttaaccaactggaagcctctaaagggtgttattaagttcttctagttaataaaaaccccaggggacattatactcaaggctcttgagctgcttgctcaagcccacaaacactctatggaatatactttcgctttaatattaacaaatctgtgccttcatcttccattgctttgtttgtgcattttgttcaattctttgctcaatgtgccaagaacctgaacaactcatagtcaagacttcccagccagtaacaagaggagtcagctcaaagaacaagctgatagaaggaggatgacagcctaaaagaataaaaagaaatttgtccttaacaatgttattaagctgccaaattggccaaccccagcactgtcttttctctggccttgtaatatgatatgccacatttcttctcatttaagatgccatcaattgtgagatgcaccattacattgtctctgactaaaaaaaattgtaatgctgtcaaattaactatgatgctatattatcatttagaatttttagaatatatttttagaatatacttttagaatttttgaatatagctaatgaaaaagtccatttagatttacttatgcctagattttttataccacatatcactcctgtgcatttaaatttaaatataaatttactaatttaaagtaaatttagctgggcacagtggcccatgcctgtaatgctagcactttgggaggccaaggcaggcagattgcctgagctcaggagtttgagaccagcctgggcaacacagtgaaatcccgtctgtaccaaaataccaaaaattagccgggtgtggtggcgtgcgcctgtagttccagctacttgggaggctgaggcaggagaattgcttgaacccaggaggcagagggtgcagtgagccaagatagcgccattacactccagcgtggatgacagagtgagactccatctccaaaaataaataaatacataaataaatacatacataaataaagtaaattagtcaaggtattcctaaatctgctttacattgagtcaaactctcttgaatcacttgtccaatcagagttatcaatgttctagtttttccacatacgcttgtcctctgtaacatgaagaacattggtgatgctgtgtttcttaagaaagtgcccttctgtaatctctggagttgttcccaagaggccatcaccattctgcaggttcgaagcacaagggcaggcaatgcttagcaacagcaattgcataacatacctcatatcagagatgttaaaaatataaaatgtatgtgtgtgtatacacacgtgtgcatgcttcttaggttataaaaagggggctaacaattttttcttattgttaacacacttttagtttggtttctattatttgcagtaaaatgcttcctttctgattcaaaggtcatcagtttaataagtatcagagcttagatttgaacccagtcattatagctccagcctaggcttctgatcactatgttaaacagcttttgtgttttagataaagtggcagatctgatttgttgatagcaattccctggagtgttgcattgagaagattctgaggccttggtctactatctgtgactgccatggaatcctgagtggtgagtcatattgtacaaaacacatatttacctttcttagataattgtctgaactctcaactttcattcaaagccatggattcctacagctagaatgggaccagcctcaatctaaacatttcagggttaatagtcaggataaaaggatatgcaaattatgtattgcacatctccagagggtaccattcacatagactatggtgtaaatggcagtccctggttacgtgcagtaaacaacttgcacaattgtccatggcaggccttcaaatagtaattctctatttcaacatcatgtatacaaacttcacagctaattgcaatcatttattctgaaattttatacccagtatgaaggtcaagttatttttatgtctaattaaatttctcctgtttaaattgaattttcttcctggatgacacagacttaagaataatacaaagcatttagtctggctctgtggaggcttgatattcatcaaacataagtgaatcattaaaaatctttcatatatttgaaggcaataattaagtctcctattctcattagcttctccagttaaacaaacccaatttacttcacaagctattactatgggtcaggaactatccatgctaagcactttgattcaggacaacctttcatcctcactataacgctataaggtgggcagttatcccatcttatgggtgaagatggtggtgggtagaagtgcagatgctgaagtcagactacctggatccaaaatatcctgctccatatgaccttgtgcaagtcacttagtccctttatgctcccgttgcctcaacaatgaaatggagatattgcagtacctacttcataggatcgcctcagtgtttctaggattcagcataatgtctggcacttagtagataatcaacactcttttgctggtattgtgattatagttccaacattccacatgcaggaagggactgagcagggatttgaactccaggacgcttttccccactctgcctctctaactctgccacagatttgaaaaggactttagagactctgtcatccaaactcttcgtttcacaaacaggggaccagaggcccaccaaggatcattcttacacacttcgctaccatggaaaacagggctctcagaatagccactcttggcctggcacattgattcacacttgtaatcccagcacattgggaagtcaaggcgggtggatcccttgagcccagggattcaagaccagcctgggcaacatggtgagacctcgtctctacaataaataacaaaaattagccaggcatggtggtgagcctatagtcccagctgctcagcaggcagagatgcgaggaatgtctgagccagggaggtcgaagctgcagtgaaccgtgatcatgccactgcactccagcctgggtgacagagtgaggccctgtctcaaaaaaaaaaaaaagaatagccactctgtcacctgttttaatgcttcagacctatctactgggttgtttcccctcccattggcatgaatggagaggcttttgaggaaaaaaaaatagccaacttataacaaataacttgaagctatgttctggtttttggcaagagctcttcctcctgcaatgccaaactgacagagcttcagaggagttcctgggcctggaacctcccagcaaacctaggacctcgcccagcccaggagcaagtgcatgcttggaaaccccagagccctacagcaattatagggcattatttgcttgccctgaggacttcttttgtgaattaatgtctcctattaaatatgaaatccaagataataaattgtcctaaagggctcagatgtctttaatcgtggttttatctactcccccaggcctggtgacttctaatgagttccagctcacatcctgaatgaattatcgttggaggagtgtgtgcactcagtgaaaataaactagcagagactcatgtttactctttaattccctatccaaaaatagtttcctttttaaagaatatttttcaaatagaggagtgaatgctgactagccccttgtgttttgttccccatgctcccaaaaaagagccacacacacagttggatttatggactacagtaatacgaacttgaaacatctgtgaccttcgacaagtcttttccctatcccaggcctcggtttattcatctataaaatgaggagactgatagctacctctcatggctgttaggaggattcatgcaaataaactgtctagttcagcatatatagtcaacgttgagtctttggaaaggttaattttttttttttggagagatggagtctcgctgtgtcgcccaggcagagtgcagtggcacaatctcagctcactgcaacctccgcttcccaggttcaagcaattctcctgcctcagcctcctgaatagctgggactacaggtgcacgctgccaggcttggctaattttttttgtattttagtagtgatggggtttcaccgtgttgcccagcctggtattgaactcctaagctcaggcaatctgcccgcctcggcctcccaaagtgctaggattacaggcatgagccactgtgcccggcctatattttataatgctataaaaagttgtgtataaattgaatttgggaaatccatcctgttttcctattgatttacttgatttcagagatacttcatctttttactttacttctgccagaattataacagatgatggctccaaaatgattttctgcctgcctctgctttctctaaaatagtcatgatctataagcaaattcttaaatgccttagggaattatgttgataggaatcctgtgttgaagtaatgcagttgcctataaaataaagtatcacctcctaaatgatccggcttgtaagttggtatattgagtttccataagttgaatctacaccatgaggatctctccatttcaatttccccagatacctcattggttaaaaaaaaaaattaggtgcaattattttatgctttgagaaggggaaggatgaagctgcccccactgctttctataggataggttactgttgctgttgtttaaagctttaatttcttagagcagttttaggttcatatcaaaattgaaaggaaggtacggaatatcccatacaccctctgccctgacacaagcgtagcctcctgtattatcaacatctcccaccccagtggtgcattggttacaactgatgaacctccatcgacacatcatcacccaaagtccataatgtatacagtagtgcccgcttatccccaaggaatagttccaagacccccagtggacgcctgaaacctgggatagtactgaaccccatacacaatatgtttttcagtcctaacgagtgggtagcatagacagtgtggatatgctggaccaagggaagatttaagtcccaggtaggacagagcaagatggctcaagatttcatccacgccactcagaatggtgtgcaatttaaaacttgccaattgtttatttctggaatttttgtttactatttttggaccacagttgatcacaggtgactgaaaccttggaaagcaaaacctcagataagggagactaccacataagggttcacccttggtgtacatactgtagatttggacaaatgtatgatgacatgcatccaccatgatagtctcatacagggtagtttcactgacctaaaaattctctgcactgtgcttatttattactctctccaggctaacccctagcaaccactggtcttttcactgtctccatagtgttgccattgttttgttttgttttgtttgttttctataattacttcttctttcagcatctggaagaggaaagggcttgtaggcagggtccctcccagccctggtggtgagggaatagctttgagtgtgagcatgtgaatctcagagtgggtgaaaggaagagagctgaacttctgaacgggagcctgagtctgggtggagatggagccactgacagaaagagccctttgtccaaacagccaccatctctcttcccagcaccttttgcccccttccctcatgcattccttacagggctgctgcaaccccaccgagaagaaaccaaaacccggagggactctagtcaagggcaccatgacttcctcttccactctgagggaatgagtcatcctctggtttctccattgattaaaagaagaatataaatatgtactcccctgggggaaaccatgcagtctaaggatgaaacctcagccattatttatatgtttaagatctactttggtcctggcaggtgcgtcaggttatgaggaggcactctgagaaggaagccaagagcaaaagattagaaaagaaaatagttgaggatattttcacctaaactcctgttgtgggtataaaattcacagtcacaattctggaaaaactgtttctatgattgacacaaaaaaaccaaatcaatctttttacatcaagataacaccactcaaaagagattacagcccatctcttttgagtaatttattcacctgaattgaaagttctctctctcccttttctccttcttgtctccccaggagcgaaattaagttcccagacttgttataccctcctgacttgttctccccttccttgggaagggcatctgttccaggcaggtaacacctgtcatcctggctggtctaggtaacacccaatgtcatggctgggcattggcttttttccttatcacacacacttctaaagtgtccacagctgatgcgacagtggcacagtaaatgtaggttgtcctccctgtgactcggcctccacttggttctcttgatcctgttgtgctctctctctcagccccaacttttggctcatccatactaagactctgccacagtgtcccctcaaaccacatcacaatgatcccatgcaaataactggttctgacttcttaactaccttcctctactctaccacagggcattgaacattttcagatctcacacacacccactggacctgagggaaactcagagacagagtactggggaatatctcaaatcctttccactcaaaatgccagcatactgctcaactgaggccacctcatgttggcatggggcaccccaacagacaagtggtctcttcccaggatttagatcctgtttttagatctccagccctctccactccttgatgggttctacacaaagcaggagggaaggggcaggtagaggataatcattctatcttcaacctgttcagagtgttgatgtgaatccttagagtatccaaggagaaaatgtacataagacattaagcatggggcctggcacagagaaagtgctctatccatcttacaaagattaaagtatcctcatcagctagcacagtctaatatgtaatcagttacttgattgatttgttaatatagctgtgttctcgtcacccatgccggcacagtaccttacacgtaagaagagctcagaaattctttgctgaattcattcattttgaggcataaaatccaatcttcctgaagataagtcctttccactgaactggtggggtgtggggaaaggggttgctggtacttcatctggggaccccgaagggaccaggatatgagttggctagaaaaggggcaggtaagtatggggctttcccacccacagtagtcctgcttcatgttcttctttcacaattatttgacagggcaccccatgaaatcaagtggctaagtcagatttaggaagtggttttgaaattgatgggtgcagggaagtacccttgagtcaaaatcagaagaaagtgagtattgctgattaaacacactcctcttatgtttgggatgcagctgatgggaagcagctgtgggaggtgacacagcaacaggagggcctcagaactgtgcctcgcatacatcgggaacataaatggtgaacgagtgaatgaatgaatgaatgaatgcttccagatgggcattctaaacttcatgttttttgtttgtttgtttgtttgttgtttttttgttttgagatggggtcttgctctgtcacccaggctggagtgcagtggcataatctcagctcactgcaacctctgcctcctgggttgaagcaattctccctgcctcagcctcctgagtagctgggattacagacacccaccaccacgcccagctaatttttgtatttttagtaaagatggggttttgccatgttggccaggctggtctcgaactcctgacctcaggtgatctgcctgctttggtctcccagtgctgagattacaggtgtgagccaccgcgcctggcctaaacctcacgtttgatccccctttgttctggggtcaccctggtgtatgttactagacaacaccttggctatctgagcttccaaaattgatgcagatagaacaggaaatgcccttggtgcacctgtcacctgagcagtagtctttgcccactatgcagtctttcatcccccacccccctccctcccttcctcttgagtctccaaagtccattatgtcattcttatgcttttgcatcctcatagcttagctctcacttataagtgagaacatatggtatttggttttccattcctgagttacagtaagttctgttttatagcagagtagagtaactataattaacaacaatgtattatatatttcaaaatagctagaagagaggaattaaaatgttcccaacatagaggaatgacaaatactcaaggtgatggaaaccctaaataccctgactcgattattacacatttgatgcatgaaacaaaatatcacatgtaccccattatatatcaataaaaaaattcaaaaaacatttaaaaaaacagcaaatgcccaaaagagcatgattcattattgcacatacatgaacaaatccctggcacaccacacttcagcccaacagcaaattaaacaaaagctagctacctcagaatgtcctacagtctactcagtgtgggcatctgagatgcataagaaccagtaatcagagctttgtggcagggctgtaggaataaaatgtaattcctgccatcaagatacttgtaacctagttgggagaaaaaataaacacagagatatagatctattcacactaggaaatatgtttgaaattacatttgggtgatatagtcatttcatgctacaggttctgaaaatagcaggtgatatcttggaggaccacagaggtgaggggagactttctggaagagatgagatggcctgagtcatgagcatgactcagattcagacagaaagtggctggtggaagggggagtccctgaacactgaggaggctgcatttacatttgtcaccttgctggaggatcctctgagaagacaatggggagagtcccagctaataataatagtcaccacatgtcaggcattgggccaagagtttggcatgaattatctcagggaatctcttcaacaactctcccaatatcatgtggcagatacagctggagtctcttcttcctcctttgtgacaggacttcaattttgtttgaggcaactatatgttcagttaaaatacttgatatcccagctttttttttgcagatagtgttggtcatcttggcatagtgtgtccaacaaagtataagatgtagtcagtgaatggggctttccagaaagctctccaaaggggtacagatgtggctggctcacgtcttcagcttcctgccattttctccattcccctttatcttgcctgcaaccagggcagccaccctgtggctctggatgattctgggagcctgtgtccttgatgagtccctggaacaatggtaccaaccctggcttgcccacttctgaactacttattgcatgagaaaaacaaactcctatttggttaagtcactgccatctaacctctgtgatttccagcacatgcaatcttaacacatatagacaggtgatgttcgtaccttgttcacagactgggaaaccaaggctcagtaagtgtcactactcataagcagcaaatccagtatttaaatccagaccaatgcagaacaaggctggttgactccaaagctagactgagaacctgtgaaactactccagagtcacattaaaaattaaagaaagaaagcaaagcaacctttagcaactttttaacctctcatataaccttttcacaacctaccttttattagatactggtaggtgtctctcactcccaaaacactgcttcagaatctcctagaaggcaggaccaggactacagctttaatcatgcttatagcaccaatttcttccccatttccccatgcccagctctggctatgtgggcacccaaaaatactggatggatttagtttttttaaaaatcactcaggataaaactcaggattaaaaacatcactcaggataactgtctctgggaaagccatccctttatgtatgtgtgtgtgtggttgtgcatgtgtgcctgagggtgtgtgtcacattgtgcacatatgtgtaaatgggtatccaagtgtctgagagcaggggaagagggagaacttttttattgctgtcaaattccatccttccactcagctcctacagacctacagtgacagcaccaatgattatattagcgataactaaacttttgtgcaggacctgaaaatttaatttccttgtgggaagcggtagagaactaagcttatttggggccaagaactcatgaactttcccagaaaagaaagagagaacagcacatatagccactggcctctgatttttcttgaaaaataaaaaggcacaagctcattttcaaatgtctcctttagaaacagctccagattcgtttttctctgtacataccccacatcagagtgggtaggaagacatagcagcccttgaaaactcattgaattcattccaatttattctgtgatttgtgatttttttcttttttgtttaaagaagtataattccatcatttttttttcttctcaagttgcttggatggtcaagaccctgtgatatatactgcgtgttcaccatgcactagaaactgttttaagagtgtttgcatgctttatctcagctaatgtttccactttgaagatcagaaatctgaggcacagagaacataagtaacttgcctagggtcacatagccaaaaaatggcagaactgggatccaagcccaagcaatgtagctgcaatgcccaagaccttaaccataccattgtatagcctcataagtctggaactcccctcctggtgtctgaggatatgagttctttgaatataagcaaaaaatggcacctctgcttaatttaagccaaaaaaaaaaaaagaaagaaagtggaaggagaggagaggcacatgatccatggttttgagaggcaaaatcccaggagagcctccttgtccccatcttagttgaagctcatccattgagtagggctgggctggggacctaagctaatcatcccaggttgcttgtgaagaaatggaaggtgtgccaccagaccaagaggatatggatataaggcaggagaaaatgaggcatgtatatgctgccatgtcaccaagaaaggaacagatctggaatggaagttagttaatttgaggttgaattctgatataaacttggtaccatgagattgacattcaggtattttcaaagtgatccacccttagaattcatccattcactcaattgtgaatgttctttcactaaatagtccttattgtgcccaagtagggtactgggagattcactatccccaaagggctcccaaagaatggtcaggtgaggacatcagacatatgtgcccattcacgttccaagctccattacacatcattgataatcagatgcagggataggttctgggcatacagcaatgacaagtcagatacagtccttaacttccatgaggcatatgctctgcatgcctaatccttcagcagatatgacaaactaggatgagcattgtgatggggcagtgcaatggtctgggaaggcatatagcagaggaatgcaatttggaacatcctggatattttccatttagccactcccagatccactttccacctatttctatccttttttatacccccaggaggatcacatttatggatcctttggtccactggatctttgatccactggctcccagctaggttcaaccagtggaggcactggcaggagattggagagaagaaggaggagaacaagatggagacatttatttgcccagctccctccctgataggtggctatagattggctgcctccctctgcatgaggccacaggtcccctgagttgccctgtcctacatccctacagctaccaccacctggccccagtaagtgctcccttcctgcctgttctagcttagcaggggagtggctgccagaccttcttagctcgtacttttcttgtcagattcccttaaatctgcccacaccttcaggaaagcccttttatttactttgtttgagtgaaccatgtttcctatagggggaagtaaggtttacctaggaagtgacataaaagcagatacatataatttaagcaaaaatagcagacggtaatgcacgaggcgacctgcagagcaattagtcccaaaagtaactaccatgtgtgttctgtcaaagaactttcattcccagtcttattaattcaatattgtaaatgatatgttaaaaatagtgggggaatgccgaagaaacactcagagttaatgagatgaatccccctacatgagcattgtgggatgtctgcccaacccacacagccaagatatgctccttcaggtgtgtcctgcccaccgaccacagctgactgaaccacaggtaggcagacaccaggcctaagctgggccaatgagttcctccctttttggggactgcgactcaagcacgttcctccttctctgccgcccacttctgaggataagcagaggccagagttccgggtcccacttgccatcactgcacacaaacgtgcagcagcagtccattgagcatgtatggtcctcacttatttgtgtgtttttaactgagtctcctggcagatggcaattacaatatttcttgaaggggcagcttttctaattggtgcaattgggccatgggcagggctgggtatcctcatgtcatacgtccaccaatgcagtgaaagccagtccagagagagaagagatgaggtagacattcagaggagccagagatgagagactgtggcacccaaagtgagaagctgtgagagcacgtccccaaggcgcctgtgccacttccggtccaatcagccatttccacccctggcttccctaagctgcctcttacaatcagttcccataatttgctgaggcgagtttgaggaactttctattactcgtctagggggataacatttctaagctattaaccaatgtgctctttattctagaatttccttttaccccgggctgctcccctttttgtgttcagcccagcagtctgccttcattccctcaaggaagagctgacataaaagaaagcaaaggggtggcaaaaaaaagaagttaatgattaaccttgagcttcaagagcttaagcataggcaaataggaaggcttcgtgcacatacaacatatttgagagaatatgagtggagtaaaggtaaggcgtcctattcccagaatggaaagacgtccctaggctggagagtaagggggcggggagaatacagaccaattaggacctaatttgtaggactcaaggacaaggtgggaaagcgtctagagatggctcaggctctgcttgagtcagcactgtccttccatattgcccaggagctatgcagaccactggagacacaccagggtccattccactgagcaccatatgtttcctgagctaaggcacctgggaaaatccccccaccatgggagccagcacctcaccactgactgcagaaatgaggtccatcagactctggtactttcttcagtccactctgagccacccaccttctgtggcacccaccaaccagagtgaccacttcagcaagcactgtacatagtatcgccagagtagcaggatcaagtgatgcggccacttagagaacttgtagttcagcaagaaatgagacttgataaaaatatcattttatctttgtgggcaagctgagaaaatgagggtaagatggcagcacatttgggggaattgggaaccatccgaacaaccgatgtgcttgaagcctgattaattatgccagggtccacttcgaaagcagtctctgtcctcagtcctcaactctgtcctattcaggtggcagctaatcaaagtagaggccatttcctgactcagcagaaaagagagtcatgatcagctgcaaggtctgccacggctcagacgtggcacccggcacacgctcctgccatttgctttctctgccctctaccacagcatccctgccacacctcttttcctcctgagcaaggaccacccagaagtcactctatggcttactttttgtgttgtgagtaccagtaagccactcaaatggactacagaaataaaggaaaggtatattaaaaggatacagggtgtctccgagaaccctggagaggagctcatctggattctttcctaggcacactaccacaatgagcaaaatctaataaactaaacaattctgcagttggattttttaaaactccaattgcaccaatcctagatgggaaggaatgcagcttgatgctagcacatgtgataaaaacacttaggattttgactgccagctcagaatgagtcaacaatgtgatgtgactgccaaaaaagccagtgtaatctcgggctgcactaaacagagaggagtgatggtgcggccttcagttcagagaatcatgtatcaaggcccagtgaacagagaagggcggccaaggaggactcagaatcatgccgtatgggggaaaataatgggagtacctgggatattgccgtctggcctccttttcagggattggtgggaatgttctggacctgagcttaccagtaaagagtctagggttagactgcctgaattgaaaccccaacccagctacttactagctttttcctacatgccaagaatgagatatttattcctcatcactaccttctgaagaaataccatcttcatccctatcatacagatgagaaaactgaggcacagagaggttcagtagcttgccaaaggtcacactgcaagcaaattgaagaaatatcctttgaatgcaaggagagtgtactttctttgttcttcccctaagcagctatacaaccttgaatcttgtcacttctcactatacttcagttagccctagggctacgtgaccaagtaccccaaaacatagaggcttcaagcaaaaattcttatttgttcacagatctgcaatctgggcaagacttggtggggacagctcatctctgctctactgggatcagctggggtggctcaaaggtggggttggaagcctcactcactctccatttggtaccaaacatctggaggctagaacagcagaggatccttggacatcactctctgtggtgtctctccacatgctctctccagcacagcacctgcagggtaaccaaacatttcacaagttggcttgtggctccctggcatacatcctgagacagactgagagagccaggtagacgctttcatgtcctagcctcagaagtcacatcgtgtgacttctatcacatccttagtacaatcggaataaccacagtgcttccctgtaaggacgaattgagacaatgcaggtaaaatgcttagcacattgtctggaagctgatgaagattctataaatgtcagctgttgttattttaaaagtggctcaaaaaagacatcttaaaaagacaaatctgctactactaccaaaaacatgcgtcacgcacccttaagcccagcaaataccttttgtccactggtgtctttccttgccccatgtagtcagacactgaagctcgctgctctgggaagtcacacctcaccctctcgtcccatccctctgataaacaaggccggtacttggaactgcctgggttgtgcttcccaggaggggtaccttcgctgactcagctgggaaggcatccagtgactcatcaactatcaaaaattgattaaacatcctcaggtcttgggaagggagaaaatgcccaggagacccaagatcctctcttaccccaggaccccagtggttcctcagagaggaaaacctgggcttgaagattaactgggccttcatatgagcggaggtgttagtcattctgggcacatacacgtctccagcattagtaagaagagttgccagctcccttctgaatattcaaactcatggctagcccccctcccgcatccattcccatggcttcaactaccatccaagctaatgagtcctaaatccatatctccaacccagaattatttcaggagcttgagacctgccccactcagatgtcccaaagggccctgaaactcagcatgcccccctaatgttggactcacctcctttccctcacccagaccacgactctcagtgaagatttccatggtgcacccagtggcccaaaccagaaatccagcttaccttgacactcccctgctctgcccctcaggagtgacccatcacaggttctgcagtttctacctcctaatctccctctgccaagaattttcttagacaacatcctcatagcttctgaacccaactctatccttctccaattttcccctcgctgctgtaagatctctgccaaatgtaaacatgagcatcgccgctctgtgtaagactcttcagtgactcccccttgccttccagataaagtccatgtttcttaacatggttccaaggccttgcttgatccagtgactatgcatccattacaggctgaattgtgtcccataaaattcatacattgaagccccagcctccagtaattcagaacatgactgtatttgtagatagagtctttaacgaggtaattaagttaaaatgaggtcatgtgtgggggcccttaattcaatatgcctgacgtctttatacaaaaaggagataaggacacagacacgaacagagggaagcccatgtgaaggcaaagaggaaaatggccattaccacccaaggagagaggcctcaggagaaaccaacccagctaacacctggatctcaaacttcctgcctccagaatgatgagaacatacatttctgttgttttaaccacccagtcggtgatactttgctctggcagccctagcatctctctccttcacctccctaaaccgccctccccaggttatgacactctagctgtgtgctcaatgccctctccactccaggctggccccactctcacctgggcatctacattgctcccaccactcttcatccagctaactccttcctccatgaagccatccctgacctttaagtatctcctaagatacccgcttccttcccctctcagagccccatgttacgactacccatttactctgtgtcaataccacactgtgtgctacattagaacaggggccatatgtatcttgctcacatctgtgcctagaacagtgtctggtacctacaagtgctcaataaattcttttggatgactggcaattaatgaaaataaatcaaataattcaaagctgatcatatttactatttttttaaaaaatgaagttcataaatatcttaatagagattcccagtgaagtccccttttgagggcttaagtttacaaagcaaagccactctgtcataaatttgtgtttctttggccaccagagacttcgaaaggaggccctaatagaaggcagctgattcaaatttagttcgggcaccaagaccacgctttaacgtgtaacaacatggtgagctgaagtcacactctgggtccttatctttgtttcaggaaaactgagccccagatctcctggccatctcactgggagtcgggaaaaggcccgactgcttccataacagacagcaagaagccctgcacctctacaggcaacccgtggcacagggacacatattcattttggtctgtttaagaaattgatgcataacgattgtgcatatttatggggtacatacagtgtgatgttttggtacatgtatgcattgtgtaataatcagctcagggtaattagtgtacccatctctgccagcatctaccacttctttgtagtgggaacattcaaaattctcacttctagctattttgacatataaaacaccttactgttgacgtagtcaccctactgtgtgataggacaccagaacattctggtcttcaccgacaccttctcctggaagtgctactgccatccccaccttatgagaatgggcccgggcttctgggtgcaaaccacctcccttaccccatcagctgagagttcactgatgctgtgaggagccaagagaaacttcactctcatgtcattttggctccaagcattccccgctgaggtattggagctttgcctgcagtttacccctgaggagtgaatctggattctctaaattaagacccatttgtttacgagataaagaaccaaattctagctccttttggagtgaggatgatgatccattccaaacaaatcccacccaccagacctcccagccccttccctggtttgtttccatccatgtcactttcccccatcacctaacttaggtatttgatttatgtgctcatcagctgttccccttccccaatgcctgtcatcaccagtatagtgagggggctctgtgagggtaaggattcactctgttctgtaccccgctatttctctgatgcctagcacattccttggtacataataggctccccacctgtgtctgttgagtgaataatatgtataaatgaatgaatgaataaatgcacatactcccttctttcctccacaaacacatggagatgagtctccactctcatcactaccttggtgattccccttaattccatggcaggggatcccctctggtgccctttataccttacttttctccaaacaggatttctgtgtgtatgccaacatcagcatctggtccatctgtggatattgcctggggccctataaatgtccctctaggaccaaggcagtttctggccatagaatgaaaccagccatgactccattgattccaaaacccacataaacagaactaccaggggcctggggtccctgccccctgcaggcagaagttctcaggttaacaagagcctgaggccaggaccttggctgtggtggtgttggagacacccagggtccaccagcaactgctgcctggggacagactggaggagaggtggtggcctggagactctgagggcaggtggacgtggcgcagcatgaagggtcaggatctggactcctgtgttgattccaccagccctggtaaaccattcagagctcctgagcctcacctataaccagctgccttgtggggccattaggagaaacaggatgggcttcacaagagcccatctcttcatctgtcccctgctcttttccccaagagaggggaatagcacagcagtgagcagcccaggctgggaatgaatcctccatctaccacttgctcactacatgacctcccacaggtttctaaaccaaccttctgcctcagtattgtttaagggtctggcacatggttaatgaacagtttttatgaaatgtaaaagaatgcaagagagtaatctgatcccaaggcgggagtgagaagaaagctgggtgtggcgcaaaggtagattcttactgttggtgtcttagaacttgaacattgtcctgtccccactattctccccgctacatttccaggtcaggggcatattgatgtgcaaacctctggcatggctgggctgctggccctgggatcctccgagaagccgcaggtactaaagcctttctcttagttgtgactgaattgagatccatatgtgctctctaccctgtggaagtggagtcagagagatggcagtttaaattccagccctgccacttagctgtgtgaccttggccaaatcagttaccctctctgtgcctcattttcctaatgtgtaaaatgcaaataatgataggtagcacccgctcatatggtggcacattactggatacatccacatccccaaaacaaatgccatgctctccagtctccttgtctttgcatttggtctttcctctaatactctcttccctcctcatctctgtctgccagaacccagactaatcctcagggccctgctcaaatgaccccacttctgggaagtgtctccaggtgtttctatcgtgtgtggcctcctcttccttctggtatcctggacatacaacctttctatggaagtcaccctggcatggggtgaatgatacacatatgttattcctagcccccttcttgaccataagggttggaatcagacctgggattgactccagctttgccacttaatagctgtgtgaccttggctaggttacttaagttctctgatcctcagtttccccatctgtaaaaaagatgtaacaaaacacctacctcataaggtttgtggcaaggattaagggaggtaatgcctacaaaaccttcagcacaatgcttagcacatcgtatgtccttaataggagtaatgattattagcactgagtaggtgctgagtctgaaaggctttcacttgaaattcattccttaggggccccctccaattcagatagcttccaaaatgcacatcttggggttagtgatggccccagggaggggcaactggtgaattctcagtaaagacttagctgctcttttgacatcagaacttttggtgcttaatggaacagcagagaagagaagacaaagaaacagaagcttgaaaggagttccaaggagacccacatgttctgtgtttaaacctcaggacaaacttgcaatgtcaccattgatgaccctgagattcagaagaattaagtgacttactcaaggccttacaaccagtggagacatacccagatcacttttactctagggctcatggagagaagaggcggtaggtggaggaaggggagagaatgctcatccagcaagagcacacactctcattatacagcaggcaaagcaatctgtggaaatgtatggtcttatttatggaaaattaattcagcatacaacttcatcataataccatttctcgaaacattaactcccatcaatgttgtaaaagtctgagaagctacaaaatgtctttttctaaaacctcctattatctataaacatccacttttcaggccaaccaagatttccctcctctcccgtttgccctgttggttttaagtctagaaaggtctggagtggctgtacgtgttaatggggcttgagaaaggttctcatcagcctgaaagcccaggggaaagcaaagctcactttaactgctctgtaaattagagtctccctttttggtttaaatccacagacacagatgtcttaccttcaccagtcctagaaacggtggtgaagaattcttctttctcttggccgatattgccctctagtgatccaactctacttgaaaaatagaaagaatccatgaaatagacaaatgactccttcacactcactggttcactcactcacctagccagccttcccgccactcactttctcatcattggttacaggcctattaggcaccaatcaacatggattctgggatgccctaggtgttgaatgattcacctgcaaaacctaagagtctggagaaaatggcccacatctgcaatcccagctctgcctcttaaagccccaaagaccctgggagtgggagttagtcccccaggctggacctgtttcctcaccatggagtagaaataccaacttctccatcttcaaaatatacaatataacatgcatatcctcttaatcttatcttttttattatttgtagagatgggggtggggtcttactaggttatgttgcctgggctggtctcaaactcctgagctcaagtgatcctcccaccttggtctcccaaagtgctgggattacaggcatgaaccactgcacctaaccttatctttattttattttcacaaccaactcctggagcacacttagatttttatcacaaagaaaaagcagagaagcgccaggcacagtggctcacgcctgtaatcccagcactttaggaggccgaggcaggcacatcatgaggtcaggagttggagaccagcctgatcaacatggtgaaacaccattgctactaaaaatacaaaaattagccgggtgtggtggcgcgcacctgtaatcccagctactcaggaggctgaggtaggagaatcgcttgaacccgggaggcagaggttgcagtgagctgagatcgcaccacggcactccagcctgggtgacagagcgaggctccatcttaaaaaaacaaaaacaaaaagaaaaagcagagaagctactaggtaagctcagaagccttaggttcaaatcctggttctgccagttacctactttgttaccgtgggcaaactacttaacctctctctgtctcttttttcctgtctgtaaaatgaataggattgagaacagtttaggtttgcaaactttggtataagcaaaattccctggcaagcttattaacaggacagaccctccttctcaaatttaacaatctggaaaatctgaaaatggccctggaccttctgagcagttaacaagctgcctaacaatacacaacagccactgagagcaagtgcggttgagccagcgcaccggtcctcaaacttggctgcacattgaaatcagctggggagcttgaaaatgctgacggcccctcacacacccccactagattctgacataactagtccaaagtaaagcctggcattgggatttttaagaattgctggagcaattcccctgtgaagccagggctgaaaccccacttccttagcccaatgccaaaaaaacttaataaatgttgaaagaagtcctaccaatacatccacatcatgactcaaacactatgcttttattcaacactaacaacaaaatagtaagcctctatcaggtgccaggcactgaagatagagccatcatcaagccaaaacaaaaagacagaaatctctgtgctcagggagatggcaataatgctgcaggccaatttgtcattttgcactgggcccccaaaattatgtagccatcccagtgagttggggctgcatatcacagatggccttacagctcacagtgagaactctttttctctttgagatgggaagcattacaactcccacagttttctgtcttggaaaagaagagatttagagatgccactgcagctttcaggaaagttactgtctgatgataagatttcaggcagggagacctgggtgagagaagacatatgtgaggcagcgggaccggccctgactgaccacatcccttatgtctgtcaagtgccctctgagtaaggctgagcgggagatgaacaaccatggccagaagctggtggctcctgcttcctcccctcccccagctgctgtcctgcagcatgcagcctcctcccatcccagactcagcggccagctgcttccagctgtagaggcaaaaatacttactcgtaatcaggattttggctttgcacctgctacctttgctggggctgaggctaattctaaggccagggatgtagagggtggaagggaagcccttttggattactgtagctactcagtcaacccccagctgctcattagcacctatgaatgaagcccgggaaacctggtgaaatcttgttaagccgctgagagcgcaggaggaggaaggatacagagacctctcctggtcgtccaaccgaaaatcaatgcttccatcactctctctccccttgaccctgcattatctttattcatagcacctacggcgagctgacattttactctatgtttgttcacttctagtggttttcttaaagatggaagatgggttaggtgagcttacaggaccctttcccacagagtcaaatggtcttctccatccccaccccggaacggggagggcagggacctgtctggagccccgaagtggggcatcaaatgagatcacaaaagagcagcccaggcacagtcatcagacctgtcctgtttggcctgcagaggtgttgttgttgttgtttgcttggttgctttttgtttttctgcaaatggcatgattccacatttaaaactaaggacgcgcaacctctctggaaaagctagatagagacggtgggtgccgcatcctcacacagcgcaagctgcttgttgctgacgtgctgctgccctttaactgggctgggctcttcgagaccccatcgcctctgggctgcccaattttttccattttctgcccagccctgaaggcctggattccacacccctcccctccctgtcctgctggctttgctccttctcccaggcctgggggcttctgtgtcccctcctagtggtggagctcaggttgcgctgggcagcataatttgcctggtggaccaagcaccaccagcttcaccctcctcaccagtagctgccagcctccccgacctcagagccacagctctgatcagccaaggtcacctgggagtcactcggcatctctcttatgccaccacatggtgagccaaggagttgattcctttctctccttccctgtgcagtttctaagaatttggccatgagagggattttattcaggtcaccaacagccccaccttttactcagcctgatagacataaacccccagccattattgtctctggtcccctccacccttcatttcccaacccccccccccttaaatatttctcaaccaatcttatttcttttcatttttctctgtggcctcaatcctccagccctgcaaatctactcaactatctctggcacgcagcctgttccttcttattattaataagactgagaataatggataataaataagagcttgctatcaaagggctctcacgccatcgacccagagcctcacaagaaccatacactgcaaatgctgacatgcagagtgtaagtgacttgtctatgatcagcagctagttagtggccgagccaagtcaggaatctattttaagtggtcttacttgtggcttatcaggaaattatcatttttaaaaataagccagtgaaaaagacagctgggattttaaagtatgcttttattacatttcaagggcaagatttattccactccttagtattgtaattaaagtaaatgaaataggatttggtattatatttgcctttccaacaaccttttggagacacctgctttgctctacaaagggaaagccatctgctcatgtattcattgcattaaatacccactcactcactcagtccacaattatgtgttgccctcctactgtgtaccaggccctgggctcaatacaaggcacacactggtgagcaaaacaggtctgctcctgcccccatgtgcttagagtctagtgataaagtcaggtgttaaactaagatgtgcaccaagaatgtatgaccagaaatatgttaagtgccaggaaggagaggaacaggggctctggtagcctctaagaaaggaatcgacctggtccagaagttcaggaagggcttcctggggaagtaaccactgccccaggagacaagaagaaatgaacacagggaagaggacagggaaggaagtgtgtaggggaggcaacagaatgtgcagcgccccatagcgcatggaccaagcacagtgccgtcgttggggaactgagagtcgccgggggagtatggtgtgtgaccaggcagcacaggtaggtggaaccagactacccagtcttgtgagcccaggtagggatctaggtctcttcctagggagcaatataaaactgctcagaatagggattgacctgattggattaaatctacttaggtgctggacatttggggtggcacagggaaaagaatgtctcaaccctcaaagaattttccgtcagattccctggcattaataaagctctgctcaaaattaggtcattggtttttctcagaaatataggtatcactcttgtgctaacaatggttttaaaaatatataaaaattaaaataataagccaggcacagtaactcatgcctgtaatctcagcactttggtaggccaaggcgggaggatcacttgaggtcaggagatcaagaccagcctgggcaacatagtgagacccccatctctactaaaaataaaaaattctccaggcatggtggtgcatgcctgtagttccagctactcaggtggctgaggcaggaggatcacttgagcccaggaggtcgaggctgcagtgaactatgatcatatcactgcactccggcctgggtgatagagtgagatcctgtctttatttttaaaataaaaagaataaaaatatctaatacctcctaagtatttgctgctttatgtttttacttattatttcattcaatccttgcctcaagttgtaagcattatcactcccattgcatagatgaggaaaatgaagttcaagaagggatagtaactgcccaaggtcacacagctactggcagatctgaggttcaaacctgggactgtctgaatgtcagctctgccatctctaggcgccataatcttgggaattcttgcccagaaattcaaggacagccaacatgacaggtctaaaccattcattcctcctgaaatgtcaaagtcaacaatgggctatactttgccaaagccactggccaactgtctccttgtcttacttgaccttctgtgccagtgagcagatgatcacccctccttcttaaaacatggttcctctttgatcagtacctggttgtcctcctacctgctgctattccttctcagtctcctctgcccactacccctcctcaacttgacctttaattgttaggctctacaaagttctgcccttggctatttttctatttataatcctccatttgatgatctcatccacccaccccaagactttaaattggatccataaactggtgacaaatccacacctccttcccccacctctcccctggtcatgtctccacatggttgtctaattgacccaccaagttaactctggacacccaccgccaaactctctcctgcccttaacaactccatctcactaaacggcacctccttgtactttgttgctgaggccaaaagtctaggtcttatccttgattcatctctttcccatatggctcacctccactccattgacaagccctgttgttttgcctttctttcaactatattctgaattcacccacttcttactacttccatagtaccatcttagtccaagcaactgttttgtcttacctggactacttcagttgcctcctaactggtctctctgcatccgtctttgctctcctacattctatttttcacacagtagtcagagatacaggtgttcaatttgtacacttaaagagtctgacctgggtccgaatcttgcctcagccatggggcaacccactttgccacttggtttccccatctctcaaccaggggtaatgaaatctgtgatagcattgtttgagcactaagtgaggtggtgtgtatatcatgcttaatgtagttcctggcttgtaatgag

SEQ ID NO: 20 - DNA, 111073 bp, Homo sapiens
ggaaattatcatttttaaaaataagccagtgaaaaagacagctgggattttaaagtatgcttttattacatttcaagggcaagatttattccactccttagtattgtaattaaagtaaatgaaataggatttggtattatatttgcctttccaacaaccttttggagacacctgctttgctctacaaagggaaagccatctgctcatgtattcattgcattaaatacccactcactcactcagtccacaattatgtgttgccctcctactgtgtaccaggccctgggctcaatacaaggcacacactggtgagcaaaacaggtctgctcctgcccccatgtgcttagagtctagtgataaagtcaggtgttaaactaagatgtgcaccaagaatgtatgaccagaaatatgttaagtgccaggaaggagaggaacaggggctctggtagcctctaagaaaggaatcgacctggtccagaagttcaggaagggcttcctggggaagtaaccactgccccaggagacaagaagaaatgaacacagggaagaggacagggaaggaagtgtgtaggggaggcaacagaatgtgcagcgccccatagcgcatggaccaagcacagtgccgtcgttggggaactgagagtcgccgggggagtatggtgtgtgaccaggcagcacaggtaggtggaaccagactacccagtcttgtgagcccaggtagggatctaggtctcttcctagggagcaatataaaactgctcagaatagggattgacctgattggattaaatctacttaggtgctggacatttggggtggcacagggaaaagaatgtctcaaccctcaaagaattttccgtcagattccctggcattaataaagctctgctcaaaattaggtcattggtttttctcagaaatataggtatcactcttgtgctaacaatggttttaaaaatatataaaaattaaaataataagccaggcacagtaactcatgcctgtaatctcagcactttggtaggccaaggcgggaggatcacttgaggtcaggagatcaagaccagcctgggcaacatagtgagacccccatctctactaaaaataaaaaattctccaggcatggtggtgcatgcctgtagttccagctactcaggtggctgaggcaggaggatcacttgagcccaggaggtcgaggctgcagtgaactatgatcatatcactgcactccggcctgggtgatagagtgagatcctgtctttatttttaaaataaaaagaataaaaatatctaatacctcctaagtatttgctgctttatgtttttacttattatttcattcaatccttgcctcaagttgtaagcattatcactcccattgcatagatgaggaaaatgaagttcaagaagggatagtaactgcccaaggtcacacagctactggcagatctgaggttcaaacctgggactgtctgaatgtcagctctgccatctctaggcgccataatcttgggaattcttgcccagaaattcaaggacagccaacatgacaggtctaaaccattcattcctcctgaaatgtcaaagtcaacaatgggctatactttgccaaagccactggccaactgtctccttgtcttacttgaccttctgtgccagtgagcagatgatcacccctccttcttaaaacatggttcctctttgatcagtacctggttgtcctcctacctgctgctattccttctcagtctcctctgcccactacccctcctcaacttgacctttaattgttaggctctacaaagttctgcccttggctatttttctatttataatcctccatttgatgatctcatccacccaccccaagactttaaattggatccataaactggtgacaaatccacacctccttcccccacctctcccctggtcatgtctccacatggttgtctaattgacccaccaagttaactctggacacccaccgccaaactctctcctgcccttaacaactccatctcactaaacggcacctccttgtactttgttgctgaggccaaaagtctaggtcttatccttgattcatctctttcccatatggctcacctccactccattgacaagccctgttgttttgcctttctttcaactatattctgaattcacccacttcttactacttccatagtaccatcttagtccaagcaactgttttgtcttacctggactacttcagttgcctcctaactggtctctctgcatccgtctttgctctcctacattctatttttcacacagtagtcagagatacaggtgttcaatttgtacacttaaagagtctgacctgggtccgaatcttgcctcagccatggggcaacccactttgccacttggtttccccatctctcaaccaggggtaatgaaatctgtgatagcattgtttgagcactaagtgaggtggtgtgtatatcatgcttaatgtagttcctggcttgtaatgagtgctcaaatatgttattactacacactgctcagatttcctcaaaggcagccttgctagatgagcatcagctgaaggtgatgctgatcagaaaatgaagcaacgcctaattcattatatgtcagcctcccagttcctatctgacctatggtggccatggagcatcacttcccgccccatccctggatgcctgttgacaatcacggatgtgcacacacactggcctatgagcagagttttgaaatgtgaagtgagatgggatttgaatagcagttttctttgcacataaagaaaccactccctgaaaccactatcctccagacccagatgggagccctgaaatttacaagctccagctctgagacagggctttgctgtcacaacttgaaagagccaaaggcctggccaagagaagaggtggatgtggccaagggtagagtcacgatgtttgtgccctactgtggacttttcaaattatgaaaacaaaaaatctcattcttatggagacatgagacccaaacatcataggctggaggatgcctgccctctggtgaggaatcacaaggcaggcccctgcattcaccttctctcctctttcctcaccccttcctggaaaacagggatgaggctacaaagtcagacagacctgggttcaagttctagctcagccactttctggctgtgtgacctgtgacaactatgaatcctctttgaaccttggtttgttcatctataaactgaaaagtaatggtattaccgatttcataaggagctgtgatcattgtagaaataataagtatcgtatctaaaaagggagaggcaatataagatagcagttaagactgtggtctctggagtttgaatccagctcttccactcactggctgtgtgaccttcaacgagtcacttgacctatctgattgtctaatctgtaaaatggggataacaattgctcctgtctccatgatacattgtgggaactaaagttgttaacacatgtcaagagccttgaacagtggctgacacttagcaggtgcctgcttgctgttatttctgcctgcttcctagggcccacagatgacctgctgtacaaagagcttgggtggaaaggaagtcccaagatcaggtggaagataattccattacgtgctccattatatgaagactcattgtaattttgcttgattcccagaaagctttgcacctgttagcaaactaactcctgaaaatgaggctgctgggacctacatgggacaagtctttccatagagctgtaagggaagacatgcagatggacacagttcctgtgccatctactcttaatgcccacttaccatgagcacacagaatgaactggcttcaaacagcatctggcctcctgcctctaatcggttctccactaaacagccaaaacagacttggcagcattcagcaatgcccatcctatccctgctcctcagggaccccagagagagtccaagccccttacctggccttcagattttcatacaatctgcctccagcccccttccctgatgctttctctccataagatgttccctctgtccacccacctcaaacacacataccactgccactctggactacttacttccccaaatgtaaaccataggtttatatctttgtgctttttcccctttggtttgctcagtctggattgcccattgtattagtccattctcccgaggctgtaaagaaatacctaagactgggtaatttataaagaaaagagatttaattggctcatggttctgcaggctgtacaggaagcatagttccttctccttctggggaggtctcaggaagcttctaatcatggtggaaggcaaagggggagtgagacatctcacatggtgggagtgggagcaagagagaaggaggaggtgctacacactttcgaacaaccagatctcacaagaactcactcactatcgcgatgacagtaccaagggagatggtgctaaaccattcatgaaggaacacccccatgattcaaccaccgcccaccaggcccctcctccaacacagggaatgctcactcacctgtgcagtcattgccacatcataggtacagagggtggtcccgccatctggtgaagaagatgcatgggcaagatatggctggatgcatggccaggacttgtctagatgcacagacgatatgtggccaaatgctccacggtaccagacacagacaatgagtcttccaaatcctggagggctggggccacctgctttcaggagctggggcctcagaattgaacagacctggttcagtgtcaccctgtgttggcagaacccccagtcccctcttctctgtgttctgtgatggtggtgaagagtgcaagtgtcatgtcagacagaactcggaaaaaaaacagctctgtaaccctgggggcataattttatctgtctgagctttaatttcctctgtctgtcaaatagagttgatggtgggactgatgtcataggttgttagaattaaaatgagtcactccatataatgtgcctagaatgatgccaggcacagaatttgtatccagtaagtggtcactgccattgtggttggaaatactctggccatttttattctccaaattccaccacacatccagcctctccattagctagcactgtgcggcatgcattctctctgtaagcctcagccattgaagaactgcccagagagacaaggcaaggtgaaaattacatccaatcctatgttcacagggaccagacgagcagattcagagttggattggatttggtcattcgtttattcattcatttaattatccacaattatgtgttgagaaactcttgtatgtcaggccctgctctggctcttggaccacagtcagcagtacagagatggtctctgccttcaaagaactcacattccagagcagtgctgttcaacagaaatcccacaagcacatatgtgactataattttcttgtggttgctttttttaacaggtgcaaggaagcttaatgatatattttatttagcccactatatccaaaatataatcattctgatatgtcatcaatattaaaaattagtaattggatactttacattcttttctgtgctaggtcttctaaacccagtacgtatttttcacacacagcccctttcagtgtagactggccacagttcaggcactcagtagccacaaggcctctgtattggacagagctgctctcttgtgtgtgtgagggagcaccaccttgttttttaattttttattttaatcagtatattgaagagttatcttcacttctatgcttattgcagcactatgcataatagccaagacttagaagcaaactaagtgtccattaacagacaaatggataaagaaaatgtggtacatacacacaatagagagctattcagccataaaagagaatgagatcctgtcatttccaacaacatggacggaaccagaggtcattatgttaagtgaaacaagccagatacagaaagacaaacatcacatgttctcacttatctgtgggagctaagaatgaaaacaattgaactcatggagatagaggtagaaggatggttaccagaggctgggaagggtagtcagtggggatagttaatgggtacaaaaaaatagaaagaataaataagccctagtgtttgctagcacaacagcgactatagtaaaataataataataattgttcatttttaaataactaaaagaatagaattggattacttgcaacacaaaggataaatgtttgaggtgatggataccccatttaccctggtgtgattgttatgcattgcacgcctgtatcaaaatatctcatgtacctcaaaaatatatacacctacaatttacccacagacatgaacatgttttggtctcccccatcccacccctgcaaagccttcaccatttttcaaatcaaatctaagcaacaggcaaacctggcttcagaccccagctcctctaattattagctgtgaaaatgcaagatccttgtttcatttgatttcctggggctgccgttacaaagtaccataaagggcgggggtgcttaaaataacagaaatgtattctctgacacttctaaaaccaaagtccaaaatcaaggtgttggcagggccatgctctctctagaggctcgcagagagaacccatttcacaccgttctcttagcttctggtgttgccagaagtccttggtattccttggcttgtagatgtgcccctgcagtctctgtctccatcatcacagagcattcacccgtgcatctgtgtcctcatgtggcattctcctctctatgtgcacctgcctctgtatctcttctcttcctaaaggataacattcatatcagattaagggcctgccctactccagcatgacctcatcttaaacacatcttgattacatctgcaaagaccctatttctaaatggggtcacattcacaggtaccaggggttaggacttcaacctatctttttggggtacacaattcaatgaacaacacagggccattgtgaggatttgacaatccactgtgtgcaaatgctccgacatctcaaagagactccttttatagtctctgctggcatcttggctgctagatctctgcttgcccttatggctgacaccagccatctctggcagttcccatcacccccagacttgccagctgcagggcatgtgactcaaactagaaatgcacaaaaggtgactccccatggagcaagcttagctactgggggactcaaaatgggaaaaaagcagaagaggtgtttgccctcctgtagagccctgctcaggcggcagaggtccgtaagacctcttgggactgtccagcaagatggagtagcctacagggctgctgcagaacggtggtcacaaccgtaacacattccttcacgttactctcctccttcaccaccgcacgccctttccctcatgccttcttccctaaggtcacactcctgccctggtttgagcacacgatccctcagatttgcttgtctagagtatctggactaagatattcaataaagggaagttctattacctttccagattccgccaaacaacatcacctccaccccactccgaccccagttacttcatgctcccaggcaccctgaacacttacagctatagtagcacttagcagatcataattacttgcttccttgcctgtctcgcccaccagtctgtggcccctgccatgaactgcactctcttcatgctgtatcccagcacctgcatggaccactttctattcatcactctgtcccgggcatccagcactcagatatttgataagtgacttgctgtgattcaagtagctaggatctgctgacacacgaggagggtgtctataaaatctctctcactcactcccaccctgcccctgagataatgcttttctatcagcttactgatgccagaaaccatgttttccaggagacaaaaatcataataagcgataagatttaaaagcaaatattgctaaaagagaaagcataagcccttaaatggtaatgagggtgtaaatgactgagaatggttcttttctgataggggctggggagtcatggggtggtggaggtagggggacaaaggtggggcagaggtggccagcccaggacattttattctcacatagaatcaacaccatgctgccagccaaagagacagctaccttctgggggcaatctgaggggtgaaaggtgcctctcccccaagttagctctgccattgatctgctgtgtgccccaaactcccacccctccacggatcaagtatgcaatgcaatgaaagaaaactcacgaagccagaatacctggttttcccactggcatttccacctgctactgtgtgaccttgggtgaagcctttattcaccctctcagtttatttaaacataacattaagatgatgatgacgatgatacaattctctggtttatttacagggtcattggaaaaataaaaaaaagtcacatgtatgaaactgcctcccagtatgtaaagtgatttgcacatataaggcatgtatgtatgtgttgaatgtatgtgtttgagacatggtctctctctgttgcccaggctgaagtgcagttgtgtggtcatagctcactgtaaccttcaactcctgggctcaagcaatcatcctgcctcagccttctgagtagctgggactacaggtaggagccaccacgcttggctaagttttctgtattttttgtagagacaggatctcactatgtttcccaggctggtctccaactcctgggctcaagcaaacctcccacctcagcctcccaaagtgctggcattacaggtgtgaaccgctgtgcccagccaagatagttattatttttagaactgtggtgaggaccttttttcttggaaacctggagctctcagggaggggaaagtcaaggggcagaaatccagctctctctgtgtgcctctcgaccactcacccccatgggcgccattctgcgtctagggttctgggtgctaggagtccatctgcccctcaggcaaaggggagctgtcactattcccctgtatactgtcactcaaagctcctgttcccagcccccacaaccccaggataatctgagctctaggcctttctcccagagtcaacaggctcccccaaaatgactaaaactctgcctgaattggaagctatggagcactcagttctcacctcagctttaacttgtcagggtggttcctagacataggctttcctctttgggggaaggttttaatgaagaaatctgaaaagtgaataggaccacagtgtaaaaccagaaaagtaaaagccacagcagtgtctcctcccagggagggtttctgttctctgcaggaaacaccccgaaatctagacttttcctttctaactctgcattcctccttgcgcactgccatttctgcactttcagtgagtcaaggcagttacaaaagcctgcccaggttcaaggggaggaaacacagacccccgcttcaatgcaggtgtgtctcattataaaaatgtccccagtgtaagagcagcatggaggatgggctatacttggtgtggctatctccggaaaatactaactgccatactagctctttaatgagggggaagaaatgttcattaaaaactattaactcaggctaaaatataaaacagaaaatagtgaataaacattcataccacaagaaaacagcatgcttgcccaagcatccccttagaatacattttgataatgataataacaatttgctaagagcttcccagctataaaatgtctccccatcattacctccttccatccagcaacgctgtgaagcaaatacatccatttccctgttagggagatggaggtccacagcagtgcctcaccctgactcacacatttgttagtgagagttttgagactgaacccaaggcttctgactctaattatgggttcctgtccacatctgaccagcaaccagtttgagtgatatttaggatctgtttcacagagtttgaaagtcaatacaaaatgttcagtctagtgatctggctgtggctttaccgcagtttgagtctgagcaaatcactttctgagtgtcagtttcaccatctgtaaatgcagaagattgcactacaggaattgaaactttttccatttaaagaaaaatgtaagcaatcacaccctttctccaggcaaaatcttacatgaggattcctactctatgaaacatctgttcaaaaatagagctgccctacccaccaaagctaaacatgcagccacccagtaaccctgcaataccactctgggtatatacccgacagaaatgtgttcgtttttccccaaaaaggctgtgcaagagtgttcatagcagctatgttcataacatcaaaatatggaaacaacccaaatgtccatcaaaagcagaaaagctaaataaattctggtatagtcacacaacagaatactacacagcaatgaaaaagggtgggcggctcctacatgctagaacatggatgaatctcccagacataattttgaacaaaagaagttagacaaaatgaacgcatgctctacgattccatttatatgagttcgaaaacagataatatgaaaatggtggttctctttggtgacagcactgatgggaaagaaccagagagagcttactgggactttggaaagattctttatcttgatctgtggttacatgggtgcataagtttatacaaactcatcaggctttattttatttcatgtatcttttgagacagggcctcactctgtcacccaggctggagtgcagtgacacaatcaaagctcactgcagcctcaacctcacgggctcaagtgatccacccacctcagcctcctaagtagctgagactacagccatgagccaccatgcccagctaatttttgtatttcttgtagagttggggttttgccatgttgcccaaactggtcttgaactcctgagctcaagatatccacccacctcagcttcccagaatgctgggattccaggcatgcatcaccatgcccagcctcatcacatgaattgaaattcgtgtgctttattatatataagctgtacctcaacaacaacaaaaagggtaaaaagagaaatggaacgactttggttgatgcaaaccagaaggtcttgaagacccctttgctcagcctccatcccactgcctctatcgattcatacccttgacggactctaagcttccatatgtacagtttaaaagaccatcagactagaccatgtctaaggaactcccagccctgacagtctgtgattcgcctttgggattcagatgcaaatgcctttccctggaaaccatccgatatggtttggatctgtgtccccaccaaatctcaggctgaattattatctccagtgttgaaggtggggccccatgggaggtgactggatcatgggagcagtttctcatgaatggtttagcaccatctccttggtgctgttctcatgacagtgagtgagatctcacgagatctggttgtttaaaagtgtgcagcacctcctcctctcactctcttttgctcctgctcctgccccatgaaatacctcactccccctttgccctctgccatgattggaagcttccaaaggcctccccagaagcagaagctgctttgcttcctgtacagcctgcagaactgtgagccaatcaaacctcttttctttataaataacctagtctcaggtgtgcttttatagcagtgcaagaatgaactaagacatcatcctacaggtgacaactgtttcaaatgtccaaatccccactccatggttaccttatctcaccccgttcttgtcaccttcttccccaccctccaatgcccaaagcccacacactaccccaggaccacagcctcctactcaaccctccttaagcatccccatctactcccaaagtcccgcagggcccctgcaagcttacctcctggtgtaagcacaggctccagagttcacccacctaggttcagatcctggctcctctacctgtagctggatgtgctttctatttatacgttgaggttgactaatggtacatatcgttgaattgttaggaagattaagatagtaccatggaaagcaattcgcacagtgtctgatgcatcctaagtgctcaagaagtgttagctagtgttctgatcattgttaactgtccccctcctgttctattatcacacacttatggatcaaagagagacaacagctttttaaaaattaacaataggccaggcgtggtggcttacacttgtaatcccaggactttaggaggctgaggtgggaggatcacttcttgagcccaggaatttgagacaagcctgggcaacatagtgaaactctatctcaattaaaaaacaaaaattagccaggcgtggtggcatgcacctgttgtcccagctacttgggaggctgaggtaggataatggctcgagcccaggaggttgaggctgcagtgagccaaggccgtgtcactgcactccagcctgggcgacagagagagagtctccgtctcaaaataataataataacaataataataatctagtagagtgtttaccacagctgtgctgcacatcctcctcacagctttttttgagtagactttgcgttgtgtgcccaaagtcacataaatgatcaaggctggagtcaaaatttaaattcaagccctactgactccaaagctcatagtctgagcctccatgctatttgcttaagaaactgtgtaatgcagttgacggagagggtacttaatctaaaggagtgagcatctgctggggccactggtgtgatcgaaagaatttagaatcggacagatctaggtccaaatcctgggctgtgtgcttcaccagctgcgcagacttacactcattgccttaactgctccaagcctcagttagctcacctgtaaattgagacgccattgtggaaggcattaaatgaacttcataatgtagccaaaactttataaaagctaatcctggggatttccagcatcaggtgatgcagatggagagtgatttgaggaagggagtatatacttcatccatgcttcacccagatctccctccagttcaaaacagaacccttcacccaaggacagcccctcctaagactggggacttttttaaacaatcaaatgatgcctaagttgcaaatgttaactttgtggtctggtctctcttcctctgttgtcagttttaaaacagttgctaaaaactaacatcccctctcaccctatcttccccttcttgtttgcaagacagagcctattagagatttcaaggcagttttgctttcaaatggcccatctttctgattccctcttctttctcagcctgagctcagcatgacttttcctccctacctcgttctgctctacacacacagctatgccatacatgagggcaattcgggtgacaccctagactctctgattttacaactcccagtttgcagcaagaagcaggtagtgaagtggattctcaaagggaatcagaaggggaaaataatttggccatcaatatgagtaaaaaaccccagacactcatatacaccccatctaaacataacccttcgccacccccaagaggtgaggcagtcgtgttctcttgctcacttccacataacttgctacaaagtcttttggcgacactccctttgtcgcctttaatgtgttgctctaatgacccacataatgagattgcacctctccaggcctgaataaatgtcatcccgtgaagtgggcatcttcaaggagctgggaaaagtacagccttcctggaagggcattttggctaagaattaagtctttaaaaaaggctgatacccaataactacaattgtacctagtttatcaaggagtctcagcttaccactgtttcaaacacagaattgccaccaactgtgtgttctcaaatcctctttaatggtgcttgacatcatcttagtgcaattccatttatttccagttattaagggttattcagtgacatttttgtttctgtaggactcagtcccatgcatttcaaaacttgaaacttgttttcttgtaatgactctcttttcctcaccacgcccaaacacatacacaaacctagacttgagtttctaagctgcttaaaggttgtaggggaaagaggatggtctcttctcaccacgccatctcctatgcgcatgccctctgctgttggggcaggatggaaagagggaaggacagagatgtttcctcatttagctgcttatgatgaggagctgatcctttttatttcagtggtcactggttcctggataatgcagactgagctttgactcctgctgtgtggctccttcatggggctcatccattgggttctttggagaatgtcgtagggccatcccctgcatattcacctacatgggtggcctggctagggctccagctgcttcctttccttttcctccccaaccacagtcttccccacactttccttctaccaggggtatctcatccagtgggaaacccacttggggaataatggcagaacagctcaagtcccacttcctaaggtgttccctcgacccaggagaaatgtatgtgtccttgacacacctgagaagccacagacccctatatccatgtcctaagcagcctcaggtgctcctgctggtccaagactcaaaaaccatcaaaggaaagataacagaccccaaattaatggagtcgacactgcaggaataggaatcccacttgtcaaataattctctttgggcctctctctcttggttttagggaaggaaaataaccatacctccttcttctctcttatggggaagtgatgagaaaagtcctatactaaggaactagtaaatgaataagttctatggatgtattcacagagttgatggattattttaatggtatgatatgttaaatgaaaagagcagtgtagcagattgcattttccaacatggcagaaacatcaccactcgtctcacaggctttcactacaatgtgacctcgacgatcctcctatcaaatgatggggtctttgccacgtccccttgaagctgggcagatctcagtgtctgccttgaccaagaatagtgcagaactaacattatgtgactttcaaggctgactcattaaaatgtcatgcactttcaccttgctctcttgagatgctcactcttgggacccagccaccatgctgtgacgaggcctaaggcaccacatggacaggccatgagtaggtatttcagtggatgtccccagctgacatctcagctgatgacttacatcaactgccaggcatgtaagtgataaccctcttaataattctagccctcacccacgaagccatccccaacctctgtatctccccatttgaggccccagacatcatggaacagaaacaagtgattccaccatgatcctctcaaatccctgatctgcagaatctgtgggcataataaattgttgttgattaacctgtaagtttggaatgatttgttatacagcaatagtaactaaaacaaacaagatacccaattgtccatagaacataatccatgtatttcatatatatatatggtagggtgggaaatatttgacactgactacagatgcctctgtcttctaagaggagaagcatagttaatatcaatgagaaagtaaatctctatcagcctctatttcacttacaaagactggtggagagacatgaagaaaatatgggaatttcaaagcctccactttcccttctttattaataatgattgaaactcagagtaggtgacccttggtgtgaatggtacttaatagtagatacagaaaggaggtctaggactgtgtaggggctgtagagctaaactgccttctaggataaatgagagaatttgaatgttttacagacagagaaggcaaacaacaaggtggaaggccggaatcttccaagaaaagtgttcggtgagaaagacatttcccctacagcaaggctgttaaggaactttccaggagagagatatataagatctaattttatctctttttttaatttttaaactttttttcttccttctaaggaaaacaacactaatacgatctaattttaaactcggcatttttatgattttttaaaatccctcctgagtcctcacactttgagtaaagtttgctacgtgtacatttcttgggagaagggcctggtgggaacaaaacacagaggccaagtttgacatgaagctcagtgccttgcacagggagagcagggtgctgtcccttcatgcgacactgtgaattcagagctcctcgggggtggacacctagagccagaacaaacccacgggactgtcagccccagggatggagggagtctcagtaagcatgctggacttcctacagaaaacaggagaaagagcttaagtcactattgtttaaatctcaaagtacagggccacctcacctgctgtcttaattataaacaacggagtggcttcttgagtggcatcttgcacaggggttagctcgccaagtcagcgtgccaggtaaaaaagtcaaaagtcaaaatgcccttgaaatcccttagcagaatgctacatgggagatggccatttctcagtaagttttgccatggctgctgtgtccctaactgtacagttaatccttgactcttagtttgactgtcagctgaagcagctggtttcagtgagagactgtgtcaaaccaaaaatacatctttttaaaccgaaacccagaatgtccatggtaagatgttttacacgctgaaaagctccgtggaactgaggtccaagggaagaacagaagattctctcccactcccatctcacacacactcccaggcagccacttactctgtggaatggtaaacagaatcactcacacttcagattctctcttttccttcctcttctctctcatgcttgcagagttgaattttattggatgtatgacatggcattctagaaaaatattaaaaatacttatgttaggcaaaaatactggaagggaatacaccaatatcttagcagtggcagtctttagatactctattattcacattttttacaatatgcacataaaatttctatcatggtgagtaccccattgggtagttgtagtacttaaaacagtgcatgcacaaacagtaggccctcaatatactttatctcattattattatcaggaaagaacaaagtttacctcactcctgtgagtaggaaagcgaggtggaggagatggcggtctacctgccagggagtcccctcccaaccctgtaaacctgcgggaggctttccttacctgccccactcatgactgggatgttttgttgagtgaggatcctgcaggattatattggccaggtgtcaagaaggagaaaaccccaacaaagattgagaaaattaggagaaaatgggaaggtagaaagtggaggctaggaagtaacaaaaatttccaggagtcttatcaatgctgtcatacaggaccaggaacagttttgagtaggactccccgttggagcaacagaaggaaggctggctgggattaggctttgacagacctgggatctgaattccagctctgccccttgaacaaatgacttaatttccctttgcctcagtttccacatctagaaaatgaaggctgatcataacatccaccctatcaagacgttgtaataatacctgcagagtgctttagtacagtgcccggcacataacgagatctcaacaaatgttaactgttgttatcatctgcatcctgaaattccctaataattgcatgtggtttctgggcacttgaattgattctgtgtttctatttacagacatagaatactctgctgttcaggagcatatctttgcaatgcaaattgaaatgtgttaccatctatctaactggctagtgcctgatattggtgaaaatgtggggaaatggacaaatcctgccctgctaatgggaatgcaaatggcttaatctctgggaagactaatttgacagcatatatcagtcccttaaagatgaccatgtggggccaagtaggtgggcagagggagccaggtagtggcaaggggttgaacagaggtgggggcaggatggctggcagaggtgaaatgcagaaactaggatggatcccattgaatcaatatatctctaaggagtcccagaaattccaggggggagggaatattataaaatacatggtcgaacaaatcaaggctgggattattatatgagtgttagagagaatgctaatcctttaagactggagacaccaaagaaaagtacttccacatgccgactgcatatccttacctggagtctcagaggcatctccaatttagcacacccacaacagacctacggactaccacacctcccactcaaactgttcatctctcaacattccactcaaaagaaaaaaaaggcacgccaccgacctagttgttcaagctccaacttaatgagtcatccttgatttctgctttccttttaccatcactaccaaggacatcacatccaatccctcaacaggtcctgtttcttctgcttccagaacagatcctaaatccagccacttctctcagtctccactgtgatgtttgatcttggcacccacctggactactgaaatagccatatatatatatatatatatatatatagtctcactctgtcacccaggcaggggtgcagtggcatgatcatagctcaatgaagccttgaactcctaggttcaagtgatcctcccacctcagcttcctgagtagctgggactcaaggcacatgccaccacatttggctaattttttgtgtttttaaagagacagagtcttgccgtgttgctcaggctcatcttgaactcctggatacaagtgatcctcctgcctcaacctcccaagtagctgggattatattcacaagccactgtgcctgacaaccttgcctatcgtcttaccttttctactattatccctttcaaaccattctacaggtaacagcttgaacgctcttttaaaaatagaagcaattgtccagtcactcaattgaccagattaaaactcattgatttctttgtgttgtccacctctttctctttgtctgccatgcatttccccttgactactaacccacagtcaacaggccttctctctgtatccccaacacagcatactcagggttctctggctggagtgcttcttctttggctcttctcaacatccacgtctctcctcaaagaggtcttccctcactagactagccacaggcactgctctagtcactatcacaataccttgttctacttcatagcacttatctccatctgaaattctttcatttgtttgtttacttgtatattgtttacatttcccccaccaacacacatacgcaggactagaatatgagctttgtgagggcagaagcctgcttgccttgctcattatttatcctcagcacttcatacatggtaaatgctcactaattacttgaaaaaaaatcaataaacgaatacctggatcatacaagtttctggaccctcacactccagctccctctagtcatttatgacttcagtgttggtggacaatgaaagcagagaagggagagaggagcaggccactggttctgatggagagatgaagataaaggcttcttgtttaaccaaagagaaagccagagggaagctcagggtttggtctgggcttgcagagcaagttgatggcaaattgaaacactaaggcttctaatacttggtgcttgtctaggtaactgctccagatgtgtcttgtcaccatcactacagtgttacttcacaatggtgcacaaagaactaagttcatcccaaaggaactcctcttgtgacatctgatcacatggcatacaggaagttggttaattaataagcattcaaatgatgaagcattgaaatattatgaggctgccagacagagctgaaacttccttaacttagtatttgctatagtttgaatgtgtcccccaaaaggcatgagttggaaatttaatacccaactcaacagtgttaggaggtggatcttaatgagaggtgagtaggccatgaagtctataccctcgtgaatgaattaatgcctttattgcaggagtgggttccttataaaagagtacctttggtccccttttctctctctttctctctcttgctctctgccctcctgccataggaaaatgcagcaagaccctcaccacatgcagcccctcgatcttggactttccagcctccagaagcatgagctgatagatttatgtttattataaattacccagtctgtggtattctgttacagcagaacaaaacagactaagaaagaaaattggcactaagaggtggagctgttactacaacaaatacctgaaaatgtggaagcagcttcacaactatgtaattaaacgaagctgaaagaatttggaggagcaggctagaaaaagccaaaattactataaatggactttgaggatgatgctggtaagggctcaaaagaagaggagagctatagaggaagtctgaaactttacttaagccatcataatcagaatgttcatagaaatatgagcagtaaaggccatactgattgggcctcagatggaaatgaagaataccttattgaaaactggagtcatggccatccttgttaagtggcaaagaacttggctgaattgtgtgcgtgctcaagagctttacagaaggcagaatttaagagcaatgaactagggtgtctggtggaagaaatatctaagcaaaatactgaaggagcagcatggcttctcttaactgcatagagtaaaatgcaagaaaaagaaattatttaaagacagaatttaaaattaaaagagaaatagagatttggaggactctcagactggctatatagtagagaataaaaaaagattttttttgagagaaaaaaaatttttaggaaaccaaggatgtgcccaaaggaccatttgataaggagattagcatggatagaataaagctggaggttattcatcagtacaactggagaatgaccccaaaggcacatgagagattactgatgcagaccttcctattgcaggctcagaatgacaacgcctggaaaaagaaaatacatcaaaagaaaggcctagggcatccacggggccttggctccaggccaggtcaagtctctgctctctgaatcctggcacagcaccccaaatggcaaattttagcagtatccgtgtggtgttaagtgtgcaggtacacagaatgcaagagctgtgggaacatcgcttcttctacctagatttcaaaggatgtctcagacagcctggaggcccaggcagaacttttctcatgggcagagtcaccgcagagagcccccactagggcaatgcccagcagaactctgggatcagagccactgcagaaagtccctactagtccttgtggagccatgagggtaagtccacccccaagaccccagaactgtagagtcaccaccatgagataacagcctggaggagctgcaggcatgagatttcaacccctgagagctgctgcacaggcctagctctccctaaccccccataggggcagggttgccaaggcattaggggaccaacccccaacccattatacaaaaaggtaggacactgagtgaaaaaatattattcttaagccttaggattcagtattattcatcttaattgggttttgaacttgcctgggacttgtttctccatgcttctttcctatttcttccatttggaatggggatgtctatcttatgctcattcaactaatgtattttggaagtagataatctgtttgatttcacaggctgacagctggagggcttttaactcaagataaattgtgccttgagtctcacccatatctaatttaaatgagactctaaacttcgaacttttaaattggtgctgaaacagttaagatgttggggctattggaatgaaatgaatgtagtttgcatgtgaaaaggacatgagttttgggggtcaggtacagaatgccatggtctaaatgtgccctccaaaattatttgttggaaacttaatctccaatgcaacagtatttggaggcagggcctaatgagaggtgattggaccatgaggatccacctttcatgaatagattaatgccattatcacaggagtgggtttgccataaaagggtaagtttggtccccttttctctctctccctccctctctttgcccttgcaccttgggatgatgcagcaaaaaggcccttgacagatgtcacccctcaatctgggacttcctgacctccaggaaagagccaatacatttctgttcattataaatacccatcttgggcatgctgtaatagcagcacaaaacgaactaagacagtattcgaggcatgccactctttattctctttccagatctgaaatcgcccacattaatttccccatctgtacaatgaaaagcaaatgatcagcaaagtctcttccagccctgatgatttagaatgtttctctttgacacgagtttcttccttcagtcaaactgatctaattactgtcctccctgtcccccactgccatctacatataagccccaagacatttgcctttgcttatattggttctctaccaataatgctgacatttcctctctgctgtttgaaatactgtgcagccttcaataaccaatagaattaccacttccactcttcgtccttattttttccagctgaaaaagcttgcctttttttaattattattatttttagatggagtctcactctgtcgccaggctggagtgcagtggcacgatctcgggtcactgcaatctccacctcccgtgttcaagccattctcctgcctcagcctcccgagtagttgagattactggcgtgcgccaccacacccagctaatttttgtatttttagtagagacagggtttcaccatgttggccaggatggtatcgaactgctgacctcaggatctgcccgcctcagcctcccaaagtgctgggattacaggggtgagccaccacactcggccaaaaatttcccttttatgaactcttggggcattttctaatccagggattggtaaactacagcctacaggccaaatgcaggccattggccaaatctgtttgtttttataagtaaagttttactggaacacacccatgccaattcatttacatactatctctggccgttttttgctataatggctgggttgagggcatgtaacagaaacagtgttgtggcaggccaggtctccattagccaccagagcagttagccttcaccaataccttattgtcactctgatgaacatataagtaaaacattaaagaactggagaaactggtgccttagtacaaaggttagaatgtgaaaacaagtccattaagaccgcacttgggctttctcagaccttagagtttaattaaaataatggaggtgttcttgcacaccttgtaccaggacctactttagattaagtaattgttgcaagcctctgaagtaattttccagaccccaggccccacatgtaggcatatcagaggcatttaagccagagcaactccatcttgaataggggctagataaagtaagtgtaaggcctactgtgctgcttttccaggaggtgaaggcattcttagtcacaggataagataagaggtctgcagaagatataggtcatcaagaccctgccgataaaacagtctgcagtaaagaagccggcccaaacccaccaaaaccaagatggcaatgtgagtgacctctggtcgtcctcactgctacactcccaccagcatcatgacagtttacaaacatcatggcaatgtcaggactttaccctacatggtctaaaatggggaggcatgagtaatccatcccttgtttagcatgtcatcaagaaataactataaaaatgggcaacaagccacccttggggctgttctacttatggagtagccattctttattcctttactttcttaataaacttactttcactttaccctatggattcgcctcaaattctttcttctatgaaatccaagaaccctctcttggggtctggattgggacctccttccagcaacataagcactagagaaaaacctctaattttagttggtctggtgagttactccaaccttctccctgtaaccagttgcagaaataaactcccttctttcccagtctgtctgcatctccttattggaccgcgagaacagacagcaggacctcgttctgtccgggaacagtgtggctcattatactgtttaaatatttactatctggcccttacaaaaaagtttaccaacctgtagctaatctatgcttctcaaacaacaagatccaggctgagatccaagcgggagatatctgaatccacatggtcaacgttgtgtatcttcttggagcatcaattttactagaagactaggaagaaaaaatagttaacagactatacatgtagacatttaatagacattaaagcaaacacatttatattatggagtagaatccaacattttgaatgaaattatgagttaaaattccaaatgtgaccaaaatttcaagcatagggaggcctctacacattgtttctgttcctttactgttaaaaatatttttgtatagccgggcacggtggcggatcacctgaggtcaggagtttgagaacagcctggccaacatggtgaaaccccctctctactaaaaatacaaaaattatcggggggtggtggtgtgcgcctgtaatcccagctactcgggaggctgaggcaggagtatcgcggaggttgcagggagccgagatcacgtcactgcactccagcctgggggacaagagtgagacttctgtctcaaaaataataataataataataataatacataagtgaaatatttttgtataaaattttagaaaacacccatgtatgctatttaatttgtggtggaagtgttgcagaattttgctccttagttcaactaaaaccgggttcttgtcacacaaccaggaagaatgaggcgcgcggacatactgaagggtgcttagagaggaatttgttgggcaaaaaggaaaaaaggaaaaagaaactctcagcaaagcaagaaggaattctgccagtgggctcccatctcacagcctgaacaccaggccaccacacagaaactgaagaggccagactcctccctcctgcaaagagtgtgaactccccctggttccaccccgttctcccagtgagcaggccagtcggagattctccggggacccctttttatctgcctaggaatttggccatctcagaagtacatttcttctgagtctttgtattcttgccacttctggcacggtgcttgactataagaactccagaagggctggcattatttattaacataaatcctaaaaggtctttacccgtcagaacggcttagaggagttccgcatgtaggcggagagatacaccagatgactctgcctgcagaggtctcatactctgtggcttattagtgcctgtattgtcactatggcaacaaaaagtctaataagatctagttaaattaataatattcatagcaatgtcatcactaatataaaattcaaattagttcttcctgagctgaaaacagaaacaatctttatatgaatgaactagtgataacctcgctgttttgttttttgttttttgttttatttgcctttttcttttcctttaactgatttatgtattttgtaggagaatggagatattagaaagtttaccgtgtccttgactaccggcccaaccactattaccatcccaccccatatctctcatcccaaagcatctccctgacttctgaggtctgaacaatcagttgcaacagtgaccactgggttttgttgtctgttgttatctttgttttgtttttgaatgcaaatgtgcctaggaaaggataacatgtaaagttaccaatctcttcttaagactcggcagatggctttggcattggttgaggatggggtgaagaaaggcagtcccagcctctgaatcagagtcaggtctgaggccaaacccccaattctgccattgacttgctgagctactctcagtaattacttgccactgctgcaccttcatttttctttcctgtaatataaaagctggaaactaggtgttctccaagagcttttccagctgtaaaattctacagttcaaggcagcataattaatggaaaaatcaagggcacaaccacacggataaaaattcagaaagataaacctttgggaggctgaggcgggcggatcacgaggtcaggagatcgagaccatcctggctaacacagtgaaaccccttctctactaaaaatacagaaaattagcgggcgtggaggcgggcgcctgtagtcccagctactcggaaggctgaggcaagagaatggcgtgaacctggggggcggagcttgcagtgagccgagatggcaccactgcactgcagcctgggcgacagagcgagaatctgtctcaaaataaataaataaataaaataaacctgattggaaaaggttacagaatcacttgtacagcataaaaccactttaactttttaatttaatttttggaataggtaacatagtccatccacatgggctatctcaaaaaaaattaagaaatatatttaaaaatcttctcccatacctcataccgcccctctttccacatcccacatgcaaaactgctattaggttttgcatgtaaactttcagtttctttatgcatatgcaaaaaaaaattaatacataggcttattttccccttcattagcacaaaatacagcatgctatatatattcttctgcatcttgcttttttttccacttcacatgtatttgaaaactttccatattagtacagagagtgccttcattctcatttacaactgcatatgattccgttacaacgatgcaccatacttatttaatcactccctgttaatgaatatgtgaactatttctggtctttttattacaagcaatactgcaatgaataaccttgaacacatgcagttttgaacatgtgtaaacatatacttatctatagataaattataagaaatgggatttcttttataattttgtgcatttgccatttgcttttttttttttttttttgaggcagtttctcactctgttgccgaggctggagtgcagtggatcaatcataggtcattgcaggctcaaactcctggattcaatcaatcctcccacctcagcctcccaaaagtaccaggactataggcatgagccaccacacctagatttgtgcatttgcatttttgttatatgttgtcaaattgccctctacagagattataccagtttactcaccacaatcaaagtttaagtgcgtctttccctcagccgcttctatacactgttatcaaatcttgggtatggaccgatttggcagatttttgaaatgctatctcaatgtgaagggggtttttttagtgaatttttttttttttttttttttttagagacggagtctcactgtgttacccaggctggcctctaactcctgggttcaagccgccctcccacctcagcctcctaagtagctagggctacaggaatgcaccactgcacccagcttcaatgtggtttgaatttttattactctttttttaatgaatcttttctgatggttaatagccatttgtatttttttctccgtaaattaatactttaagctctttctcatatacgtaaatttttaaaacatgcatactgattgtttatagccatgaacatgcataatgaagggtgggagagaaactctaacctcaattgagaggctgctgctggcaaggatggcaggcgggtgggacagggcagacagcagagacacaaagggattatcgatgagggggtaacattttatttctttaaaaaaaaagcacatgaagcaagaaagaaaattgaaaaaaaaaaaaaggaagcaagggagggaaagagaagacaagctttaaaatcagtaaagctgggcttgaatctcagccacaacacatgctctgtggcctttcaaagctctcataacctctctcattctcaatttccgcatctctaggatgtagagaatttaatgactaaagataatccatgtaaaaccatgattagcacatcattgttgctaaacagtcatattacattgttaatttgattattattcaaatgtatatgatgcctcaagccaagagaaagggtctggtggcttttcctggctcaactacctttttcctgttaggtttccccagggggtagcctcttgttggtgacatcatgccagcggtttcaccctctcttgactattttccaaatgtcctccccagagctgcccctgttggtgtaactggcgtgactgagagaagcaaggatgtgcttggggtagggctgggagggggagtttcctctgtgtcgcaaccactgtttccaaaagctgtgacctctgttagctgtgagattttgtcttcctgttgtggcaacatctgtagaaccacatccatggtttacctgcagcctaaaacgccctggcctcggaggaagctaacacctctttctccttagtttgcattacctcaacaagcagtaggctgccccaccacacccaccacaccccaaagcttcttgatgccttgtttttccaaagcctcagagacacagaaaagttattcctttgctgtaaactccttttatcagaacagaaatgattagagcaatgaatttggtacacacctttttcccatctttgaattattttctgagttgaaatggtttctattctttttcattattttgatcctaaaacatcagaacactagaaaggagagaagagacaaaggaagaaaaagaaaaaaagaggattgccgaggcagaaagaagaaaaaaaatagggttgaaacagatggtgtcctgccagagtcacctcttaggccctggagacaagctccagaaataatctaaaggcctacgttggacaccaggtccttccttagtggctgaacctttgctctcagagaccaaatagctcttgtatagctaatgcccagctataagtgagagaatgctgggtgagcttaaaggaacaccccttctaataacatctggaagcttcaccaaaccagcaaagacaatgtccttcaattataattgcagcgatgaaccaataacccatcaaccaaatcatgaacatcatggagaaaggaattactgtttttcacagaggtgaagatcgctttatctttggcagaactgatctgaagggaaattgtaagagacatgaaatttaactttcctggcatttgtgaatatttcttcttttaataacctggattccatgaaaccaggaacctctttctgtagcatcccttgcaggcctgccatcacatttactgccagtgcctcacctctcttgccttcatccaaatttccctttcattggcctagttttctggagctctttgctgggagacagacaactgcctgttctgagaaaccattccattctaaagtgataatggatgctgcaataggtagaataataacccctccaaatatatccatgacctaatccccagaatctttgaatatgttacgacatagcaaaggggactgtgcaaatgagattaaggttaagtactctgagattatcccgcattacccaggacagcctaatccaaccacgagtccttaaaaacggggtcagtttccttaaaaatgagtcagagaggtgagaggaaagaagagtttctgactttgaagatggcagaattgggcgtgagtcaaggaattcgggtggcctctagaagctgggaatgtccctcagtgatagccagcaaggaaacaacatctcagtcctacaaccagaggaaatgaattttgccagcgacctgaatgcgcaaggaaagagatcctcccctagagctttcagaaggcacatacccctgctgacaccttgattttagcccagtgagaccatgtcagacccacagaactgtaagagaataactttgcattgtttaaactacaatacttgtggaaatctggggtgtttttttttttttctagcaacagtgctaacatgagactcagtcagtagggatttcagtttgttttctaaagcaaccattacggtacaacgtgggggaaaaaatgtgtgcattttggagcaagcaagttgttttgccacagtttgtggtcaggtgtgtacacattcatctgtccaataaacatttatggaatgcctactatgtactaggcacatagctccctacacatatgcttccttttagatcatatctacataagtggattcagtcagccagcaagtcaacaaatgttcactgagcatctactatgtactaggtacaaggacaactcaattgggattcactgaaaggttctttaagctgtgtgcctggggagcctgagattccaaattatgcaaagtaagattggaagcagacagcactgaagtctgttttcagaacagctatgagatattgtcttccttttataaatgagaaaactcatgcctagagggattaattgaccaagtcacaccatcagtaagtgatggagctggaattttttaattaaaaacaagtaacagggcctggcgcagtggctcacacctgtaatcccagcatttttggaggcttgagtccaggagttcaagaccagcctaggcaacatggtaaaaccccgtctctataaaaagtacaaaaattagctgcgcataacataaacgcttaacacaaaatgtaccatcttaaccattagccactttaagcatacatttaagtaatgttaagtacattcacattattgtgcaaccaatctccagaactctttttatctggcaaaactgaaagtctacactcattaaacaacaactactcattcctccctccccacagccccttctaaccaccgttctactttcagtctctatgaatttgacttttctagctacctcatataagtgaaatcatacagtatttgtcttttagtgactggcatatttcacttaacatgttcgtgttgtagcaggtcagaatttcccttgtttttaagcctgaataatattccattttgtgcatataccacttttttttttttttttttgagacagtgtctcactctttcacccaggctggagtgcaatggcaccatcttggctcactgcagcctcgacctcctggctcaagtgatcctctcatctagcctcccaagtagctgggactataggtatgcatcaccacacccagctaatttttgtgttttttgtagagacaaggtttcaccatgttgcccaggctggtctgaaactcctgagctcaagcgattcacctgcctcagcctcggctgggattatgggcataagctatcatgctcaccctatataccacatttgtttatcattcttctgtcgatgaacacttggattgcttccatttggggattccattttgtcaacagtgctgctatgaacatggtgtaccaatacgagaccctgctttcaattctttggggtgtataccaatggagctggaatttgaaagcagatctctctggctccgacacccattctctttccagggtgccacacagcctagagggaaattgtggcttgccatgctgcagctaaccagatacaaaacattttttgctcatattccattctacatggatcagatcaagctagttttactctatgattatccagtgataaaaatacaacctgatatactgcactaggaataaatttcaaactccttggtcctagtgatctggcctgcgccaccttttccaaccccatttcacaccacttgctgtatttgccatgctctgtgtatttctatccctcaacacaccaagcttgctcccactccagagcctgtgcgtttgctatccattctccttaggactttgcataactggccccttctcttcattcaggtctcagctcaaatatcaccaccttgaagtggaggccttccagatgaccatttgtaaagtaaccccttctatcaccatctatcaaattactcaattttattttcttaataactagctaaaaacaatttatttgcttttgatgttttctagttcgttatctgactccctcagaagaatgtactttccacacaaatgttacccatcttattttcctaatatccccaagcatagaaccatgtctggcacacagtgctgcttattagaatatttgtcaagtaaaggaatgtgtaagaatcttcattgtgacgttgtttatcatatccccaaaaaacccaaaatagtatgaatgtccatcagtgagaaatggttaaataaatgaggtacataatatggacatttctacagtcattaaaaagttgagatgacccattattattaacaagcaagaatgttttcaaggtatggttgattttttaaaagcaaggtgcgaaacaataagtatgctataattcaagttttgtaagatatcaaaactacaggtgtacatgaatgcttgggactatcccatgtacgggtgaaagggagggctccccttggccctctgaggatttgctgaaataccaactcgcgaaaggcaggttaattggagaaaaggcatacaaatttatttaatgtgcatacacaggggacttcaggatgaagaacaaggatacaggggaaattgtccatttttatgcttaggttcaacaaagtgtgaacagccatgtagaaataggattagggaaaaaaaaaaaaaaaggtctaatctaatgctaatagactgagcagggaaacccagcaaggcctgtctgtcgaagttcttcttggcctctctgagcagcattccttccttctgggaatggggcagacccctctctggaatgggggtcaaacaaggtaggtcagctaatctcttcatggccaatttttacacagaaaggcagaggggaacactggcataataattctaggttttgtggctgtctttggagaaaaggggttctggttcctatgccctaccttgggaaaaagggattctagtttctctggctagccttggggtagaaaggggctgagagacaggagggcagaggtcagagaaaaaggttttggcttctgaagcctttattttggggtattgttttctgagtcccaacacccaccagcagttgtgcctggggaacaagattacagagagtaaagagatattttccatttttcatttcatacaccttgtattgtcagaatgtttcactattagcttcaattgcttttgtaatgaaaacaatcctattatatttgctgaagtgtttagacaaggaatatactgatgtttgcaattagctttaaaatacagtatataaacaataggatgggttgagagatggatagaggattagatagatgaatatgtgataaagcaaggacagaaaagtattcattgtagagttgagacgacaaatagatgggtgttcatggtgcaagtctttcaactttctgattgttcaaaaatgttcataataaaatctgggggtagaaatcttactattctcgaatgcctaccatgcatcagacatgcactgtgagtttcttgagttcatgttcatgttgctgcaatagcacctaaatggcatcacagcccattgtcgtgaccccccgccaattcatgctgccagttatgccacaggacccttgcatcctagaaaaccaagattcagcagcagagctgcctacatttggatgtggtgtccctgtactggacagcccagtgcctcaaaggaagattgggtcagagtgtcaaagaatctgtatttgtccaagttctagcagaaaacaagaagcatcctcaaaacagtcaaccggagacagtttgctgaaggcactaaattcagaggtgtggtagaactagggagcggctggggatggaagcgcacactgagaagacattactacccctaggcctaaagggctgggaaattgtaaggtttctagagctcagccaatggaagccgtgggcacaggaaacagacacttcccaggatgcagtaaagggggcactgagggattaatgaccctgcttctctcttttcccacaatcccttcttctgctagtgccttccatcaccaaacctcacaggaatccggagagtaggagtggccaagtgacagtggctttggaggtcagcattccagacagcaagctggacagagcatgaatctggggatagagtaggagcacggatgggcagtcagaaaaaataataataataataagagcaataatcttacaactggcagagacttgcatccaactaatcttataatccatcatccaatacaagtcatttagagaaatgggccaggcacagtggcttatgcctgtaatcccagcactttgggaggtcgaggtgggtaaatcacttgaggtcaggagttcaagaccagcctggccaacatgcaaaaccccatttctactaaaaatacaaaaattagcctggcatggtggcacatgcctgtaatcccagctacttgggaggctgaggcaggagaatcgcttgaacctgggaggtggaggttgcagtgagccaatatcacaccactgcactccagcctgggcgatagaacaagactccatctcaaaaaaaagaagaatgaaagaggttattattaatcattctaccaagtctacaggcaaagccagaactgcatggctactctactttcatcatctatttcagtccctcaatttgcagatggggtcactgaagagacccagacaggtaaggtgacttgcaaaaggttgcacagcaggtcaggggcagaggtggaaaaagtctcgactgctgacacgcaggctggggaccttgatttttcaccacttggtcacaatgatcaggctcagcaaaacacccctccaggctactacaatacgctcagacgactctggggaaaggacagctcatctgtgtgtcccaagaagcatgtggtttgaagctcctttttttcttatatttttttcttccccctttttgtggtcaaatactgggctggctagaggggaagcactcaggtgtcagtggggtttcactgctatttcattacataagtgaaagcctgcaaccgggagaatgaaatgcaaaacagggccatctgacaagctccctggctcttccctgaggggctgcagggctgcctcagtcacccctcgtggtgccttcttgtctctggggacaggctgttgagacttctgggaaatacccgttcagtgaattcctcatccaacaactatgacttgagcattttttaagtcgcaggcactgtgctatataaggatgatgagaaagacatggtcattgcccttattaaaagatcccattatagaagataataggatattacgggtggtggttaatggacatatatacaaataaattaattacagaccgcagcgctagaagggaaatagagtgctctgaaaaacagtaataatggccaactattaatgtcatcctttctccacaactgctccgtaaggtacaaacaattattacttccatcttacggaagtgggaactgtggcagagaagtcaggtgattgcccaaggtcaattcactggtatgtatcagagccgaacttgaacccgtgagtggtgtttcagagcctgggtcttaaccactgtctatgttggggagcatatacttagaaaggcatggaaggcccttccaaggagggggcagaagaatgatctaggcagaaaaaggagcaatggtcaatgtacaaagtggaaagagagcctggggtgctctgtaatttgtcagaaggcctgggagattggggcgggggttggattttactctagttgcactttacaaagtgtcttcgcagacatacattttcctaggttaccatcagagagcctggtaatcccaagtggccatggtattatccatgttttacagaacagcgtacattgtttttgggaactcagggcaaaggtgagactggcccctgtgactttggactcatgtccagtgctctctctatgcaaccccagctcaggaacaagccacctctatggttccttaagtacaatgcaccaaggtaatgccagctcctcttgttcccttctctgccttctcccaccccaggattcacctctccagctgcctcaacaacctaatttctaggggaagctgataaacaaatctgtgctcatttgctaataggtaataaaaaaccctgttggaaacctacagacaacttgtctttacatccctgtgagaacttacaacagcctttccatttttccagtcataagatcagcctcaagctattagacatttccttctctgccaaagaggaagtcattcgttgattaatagcctattcccagaggaatctagccagagtttgagcccaggcttctggttaacaggtggcagtttgcagatgccaataaaataagcattgttcaaagcacctaattccttgtctgtgaataatgatctcttcagcctcagaaaccagtcccaggagatcagagcagcaggctccacacccccagggctctcagcccctcagcatggccccaaacactgccttcctctctgcctcaactagtgccatgtcctaccttgaccttggggcccagatgccccagacccttcacagctcccagagcacaccatgtgacagccttccccacctccttcccaggctgtctcctttacacctgtgaaacataacccagagacgcctcacccaggaagccttccctgaccgtcccgcctcttctcggtgctttcataatcataattctccgagttcctaggacatgctgcacactctgttacacactccccagggattatctcaatctcatagcaatttagagacacatcctactgttttatcattgaagaaaccaaatcacagggctgtgcccatagccaggcaaggagtgctggaggggaatacaaacccaggatcatcaccctctcccatgctcaccatcacaactaacatttattgggcacttacagcatacctcccatagccctaagcccttgacatacattttctcatcgaatcttcacagtaatcctatgcaatttagtcactataaggtatgtgttattagtatatccattttgaagatgagagaggtttaattattttgctaaatcacacattcagcaaagtacaccaccacaatgcactgaaattgcccagattaggtgacacagctagtaatttacccaacatcccttcttctcctctttcataataacaagactatattgttagagatgacaatgtgcccagtttaaaaaagaaaaaataaaggctaaacaaattatctcctatcctcctttggagatagggcaggcaatgaaacgtaagtcaacatcatgggataggggccctaggaaagcaatttaaagagggtgtactctggccaggcaccatggctcatgcctgtaatcccaacagtttgggaggccaaggcaggtggatcacctgaggtcaggagtttgagaccagcctggctaacgtggtgaaacactgtctctactagaaatacaaaaaattagctgggcgtggtggtgggcacctgtaaccccagttactggggaggctgaagcaggagaatcgcttggacccgggaggtggaggttgcagtgagctgagatggcgtcattgcactccaggctgggtgacagagcgagactctgtctcaaaataaataaataaataaagagggtgtacttggctaacaccattttgcatttctgcctttttccctcctcctgcttgagacatgcagtgtggatttccaacagctgtcttatgaccacgaagcaatcctactaaacattgccaagcagaagaatcaaaggaacttgggttcccggtgacatcacagaggtcccaaaccagccctgggccacccagctccaaattacaaggaatttggaagaaaaagagacccttgtttaaatctctattgttttgattctctattacttgaagccaaatgcaattcctcactcatttactttgctatgtgtctgatgacctgttccctgagccgtgaggtcctcaagactgaatatgctgccctcttggtctcggtaccagtgtccctagcacagcacctgctcactgtagtcactcaaatcaaccgcttcttgccattctactccccctacccctgcctgggcaaaggaggtcatgttaggaaaacagacatctccccttatatgagaggtaacaacaccaaattaagggaaggatgaagaaaagcatgaagggaaagaaagtgagtcccacctgtgaagcaggggactgggaagggcccatgctggctgagtgccagagctccacttggtcttctgtctcaagccatggtgatgtcatttccatgcctgggaaacccagggccagtagccaaatcaaatctggagagtggagtcagcagagtacctgagcctgagctcaatatcagcttatgcaaaacagccagcatcccaagtgttgcaatttaaggcgctctgaggatggcctcatgcccactgtctccaccaaacctgaagtccctccacaagcagctgatgccagtagggtgaaaggctttccatgctgtggtcccgggacgagtgcactggctgttggggaagtcagcttctcagaggctcagttttctcctctgcacagtggaaataatactgccttcccctgcttccatacaggagccaggaagaggatcaagtataaaaatggacaggaaagccctcttataaacactgaacctttacacaaacccaaggtaatgggtgtatatttgtttttctgaggtggcctctgcatccacaattatggaaggttccttccagatcctaaatactacattcattataatctttttctacactcaagtgtaagctgctgataaaaggttttttctgaaaaagacatcttctgaaatcgaaaaggtgggcatagggtggagttccatagcagtgaaaatagaaagccaagagaatggaagacagatgcatgagaaggagaccatgctgttcacataatttgtagctctgggatggtggaaggagggaactaagatgaattggttggtttgcttgtttctggctcctctggagatggaatattcaagctataggtgatcttccttagcttagatatttacaaaacattaacttaatttctttagggaagtgagcctgggagtttgagcagatgggaggaaaaaggacttttaaactttatgcctttccaaatatttttgtttttaccacaatgcatttttttaacaagttgggctgatcacaaggtcaagagaccgagaccatcctggccaacatggtgaaaccctgtctctactgaaaatacaaaaattagctgggcgtggtggtgcatgcctacagtcccagctactcaggaggctgaggcaggagaatcgcttgaacccgggaggcaggggttgccgtgagctgagatcacaccactgccctccagcctggtgacagagcgagactccgcgaaaaaaaaaaaaaaaaaagtacttataggcagggtgcagtggctcacacctgtaatcccagcactttgggaggccgaggtggtaggatcttttgagcccaagagttcaagaccagcctaggcaactgagcaaaaccttgtctctacaaaacattttttaaaaaaccagctgggcctgtagtcctagctactcagaaggctgaggtggaaggatcacttaagcccagggactaaggatgcggtgagccgtgatcatgccactgcactccagcttgggtgccagagtaagacccctctttaaaaaataaacaaacacacaaaaacaaatgaaaaataaaataaaagtatttatgtgtttattcagagtttaaaatgtgattaaacaaaatattcataaatcactttaagattgcctgggttttcacatccccacccccttcatggggccaccacatgatacagaactccatagtgtttagcccaataattaggttctggccatcatattgatgccactattaaagggaattgaggctggctcacttgccagttctgtccagccctgcccctggcattgagaagaccaagaaactgcccctagggtgtagttgcagggatgctgaattcccatcatttgtcaatcccgtgggtccaagatcagaagggatatgctttaacccaatgatagcattaagtcacaagaggaattgcccattagctaatttacccattagcagaggttagcttatctgattagctcattgccaccatcgcctactcctgccaatagaaagcagaacctgaagggaataagcaagggatgtgctcatttttatatatggcaaaaaaaatttaaaaattaaacgttagaactcaaaaagacctgaaggatgatctagccaggaggctgtaaactggaaagctctggctttatgtattttgtttaccaatgtagttgtgttttctttgaatctgaaagtctttatatgcactttccctctaatcatgctcctcatccagttactctatacctgactgcctctaatagttatgttatctgcttggtttccaaagtgaccctgccgggtctcgagtccagcctttggtacctatcctggtaccctttggttagggctaagaatctaaagggattaacaatagatgcactcaagaggttcagggcacctaaaggagaaggagatacaaaaataaataaacaaaaataaaagttgaacaaacaacataatgtctctgaatctcagaaatctctgaatatctcctatagaatggggttaatactgcccagcctagagttggggagaacctgatcagagaaagcatgtgaattgccttctcttatttttaaagaatattcctgtcctttaaacagtggtctttaaagaatgtctcagtcctttccttcccagaagactcaacatgctctctccaacactcttgcctcatgattccacagcccttacctaataaactaggtaaggagcatatatgatcagggtgttccagagaggtgagccgaggcagagaaagttacctgtccttcatcacttgggcaggcgcctccatccagcaggcacccacttagcccataatggcagttggagctatgtcaccaaacccacccaaaacttgggcagtggaggtgcatggtcttgataccactcatcttggtaattaattccacacaaatgagctaacagagaccagtcatcacacatatgccaacagcttgcttactggtttttttccctgctttttcttttggcaaacgaaacattccttcagcccgattattggcctctagcttgtcccttggatctgacagctgttggttcatggactccaacctggcctgtcattttagcaacctagctaaaacttcagtcaatgggggtaaaatgatcatttgatggcataaaaagccaccatccaggggcgggccacggtgtggccttgtgagctgggtgccctaaaagactgtccagttccagtgagctgcagaactcctgtgtcctgaccccatctgttgttggcgaacattaacctgactttaaatgactaagtaatcacatcaaaatagaaaccagggtggctggcccccgttgaaatcttggcattttggtctctagtaagcagtgaccttccatctgggcccgcctctttcttctcttctctcctcatgatattatctttctttggattttccatggagtttcctttctagcatttggttcttgggtttttatcactttacactaatttcctctttgtcactagcttaagacctacccttccctctgcctctgcctcctccacattactctttcttcctcctttttctcctccccgtctcatttctgtaagcattcctaaaacccttctacttttgataagaattgaagagcctgtcaaagagagagagaaagtagagttcaaagttcaaagcaagaactttggtggcagctctgagtgtgacaccaagatttgcccttagcaacggtgtagctttgggcacatgatctagccacctggtgcctcagtttcctcatctggacaacaggtataacaacacctatttcatgggattgaacataatgctgtgaatgtaaatggctttgttagcaaagagtcctaccatatgatatattctaaataaaatttagcttagaaaaaaaaaggattcccacaatctttgctctctatcatggtttaaatcaatagggtcccaactacgtgcatcaaagaactaaagctccagaacttacctgggatgggctggatgacaacaggatgagccctaattaccctccctttttttttttttttttttttttttgagatgaagtttcactctcgttgcccaggctggagtgcaatggcatgatctcagctcactgcaacctccacctcccaggttcaagccattctcctccctcagcctcatgagtagctgggattacagacgcctgccaccacacccagctaatttttgtatttttagtagagatggggtttcaccattttggtcaggctggccttgaactcctgacctcaggtgatccacccgcctcagcctcccaaagtgctgggattacaggcatgagccaccacgcccatcccaccctccggcttttaaaacagtttctattttctctcttttgcatattggatctctgaataatatcctgaaaaatggattccattgccatgaaaattttttcttaaattgattttttcactttttcttttgccagaattcttctatctttgttcactccaaatgagaagtacctgacacatagaacctgcaaagtcattgttccactccttgttacttccttgcaatttgaagcccctctattttaaaaagtatgactgacatttcttttctgtaaagaagcggtagaggagtttagcccacctgtcagactctcttcgaagatcttttcaccagcctccgactatcagatagtgaaagacggttattaggtatttggtttcatttgaagaaaatggattgcccattttctttactatttgagaaatttggttacacccaggatttcacgcaagaacctgtggtagtgaattgaatctgacaaagaattccacatagtaagtaatattgtttcactaccttaaaaaaattatcttaaaaaaacaaaaaggcagggcgcggtggctcccacctgtaatcccagcactttgggaggccaaggcagacggatcaccggaggtcggtcgggagtttgagaccagcctgaccaacatggagaaaccccgtctctactaaaaatacaaaattagaggggcctggtggcgcatgtctgtaatcccagctactcgggaggctgaggcagaagaatcacttgaacctgggaggtggaggttgcagtgagctgagatcgcgccattgcactccagcctgggcaatgagagtgaaactccatttcaaaaaaaaaaattaaaaattaaaaaaagagtctgaccttattgaaaacagatcagaaataaatattgcctttattctctcaagggtcacctagaggtagactcacccccaatcccccatacattcacccgctctgtgtacacaaatgtgtacacagagttcagtgagattctgtgcttttggcagggacgttcagatgcctctttcctgctccatatgcattttgcattccccatttacatctctaatattttactgagggaggtggggagttatacggaaggggcctaggaagaagagagaaaagaaaagagaagggcaactaagatggaggctcctcgatccctccatcgccctggttgtgagcccacgtgaaagtgagtgtggttggggtaagctgctataggataaatgttcatgaaagatgacgtacacacagagctgcctcaggacccaggaaaccaagagggatgtttgattgaaagctccaagacagcagagctcagagctcatgacaacgtcatgggtcagtgtattcccagtgcccaacacattgctgacacatcgtgaatcgaatctgacaaagcattctccatactaggcacatgctaagacacacaagaaagagctgttggatgaataaatcagtgaatgaaaaaattatctggagaagagccattctccctgcctcccccaatacctattccacagtagtccacattggagctgatggcctctctgcttgccctcctgttgacaaatccaacctccactgcagcaagagtgatcaattcaaaatataaatataaatataaaatgtaaatcaggtcttctcattcccctgcttcaaatcttcagcttaggacttaagatgtaaccaaagcctttgcctgtgtgatgtggtcccagctagctcagtggcccctccctggccctcatcccttcattctctatactccagccactgtaatcttttgcttgttccctggacaagccgagctcattcctgcctcatggcctttgcacttgctgttccattagcctggaacactcttcccccagatctttaaatgaaaagatactttcttattattcatgcctccagtcaaatgacacctcttcacagaggcctttcttgagcacctaaagtcactgtctattcatttgtgatcacaccgccattttctttttcttcagagcgttaagcactcaggaatgattttgttcatttatgtggcttcattatcattgtcagtcttggacattctaatataaactctttctctatgttgtttgcagctgatgattccccaatgcctagaacaaaacctggcacacagctggcccttgataaatattttctgaatgaatattattaatattatgaaattatgaatatgtattatgcagccttggcatcctgagggctctgggcaataccaagtgaattttcccagaagttgatgcatcagaggcagcagacagatgcttcaaatcaatgcatcaggaagaaagaaagaagtgtgaatgatgacagctgacatttatagaacatttattacatgcagagattttttccaagtcctcaatgtttattatcttttataattcttgcagccacccctgaagcgaggtcaaattattatttctattttatggataaataattggaacagagaggggaagcaacaccccctaggtcacaagcgtagtaaatggaagatcaaagatgtaaatccagactattcaccactacactacactgcttctctcaaactgacttaccgagaagcacaccttccctgggtggaggctagcggaggcaggaagaagtatgaagcaagtcaggtattgatatcagtgtgaacacagaggtacctccagactggtgaagcctgaagcccagggcatacatcatgaatggtctcacgctgaaaggaaaatgctctggagtctgccacttagccctccagcaaaaaacacctctggttaaattccaggcccacagctgcagcagtgcctcaggcagtccctctgtctccatttccacccctgaagctcagagcctgagagccagacccaacctacagacacagtttgcttcatactcacaatgtggcctatatcatatatattttttattataattgtggccagcctttaaaatagctacttcacatttaagttcagttttccagctcttctctaaacatcacaagaactgtgatgcccatcttgctttcacatctggcacagtcagctggatctgaggagcgacctgcctctgggaaagagcatgcgccatgggttcactgtggtccccaccactccctagtttgtcctcagtcctgagccttgcctccctgtctatgtgtatttgtttacatgtgctgtgtcgagcctggacgtttgagctcgtgatgtctggtgggcgttcattgccacacccctgcaccccgggactgctctgatgggcctcctgccttgagtctcacatggctacagcatcatccttcataacgccatcagattccagcatgatcccagccacctcaccagaactcaaacttgagctcatccttggcactgccacttgctatgtggcttgtcctttccacctcagtttcctcatctataaaatgaggagaataataataataatatccaccatcttcatttgtccctgctactataacaaattactatataccgggtggtttataaatagcagaaatgtattatttacagttctagagtctgggaagtacaagatcaaggctctgacagattccatgtctagtaagcctctgtttccccacagacagcggcttcttgctgtgtcctcacatagtggaaggaataagccagctctctggagtctatgttatcaggccactaatcccagccaggagactaaaaggctccacctcccaacactctcaccttgggggttaggaattcaacatatgaattttagggagacataaacgttcagaccacagcatctaccttggagggctaatgaagattttaaagacttataaatttcttggaatatgtgtgacagaagacctaaatttaaaaccccaatgttatatgttgccttgacatctgggagaagctgggaggacctcaaatggcataaccacaagttcccctccctacgctgctatagcagataaggactccctgccaaagaagccttcttttcaaagggaccaggtgtggtgcctgcttatctcttagtagcgggttttcattctgtgtcagtccacaaaattattcaaacgagccaatcacatcctcccacaggaaccaaggagcaccacagccttgtgatactacaaagcctgccttctacatacaatccctgctagtttactctgctccaaagcataagtgctacctaccacgtggtgtcctccttccctggatgtgagtgcagtatgtgtgactgacaagctgctgtcaatctcatctgttcagtgtcaagtgtcaagtgtcggccatccctataatcctagggcaggaatccctgcttcaataatcgggtgagtatgaggtaagtaaaacagtataatgaagtgcctaattaatggtggctgctaataatccttgaataacaacttttgtaagaagaaaaaataacatttgattttgcattctaggaagtttttcatataatacatcatgtcttttaatctgatcaatggctcaatgaaatgtgttaccatcccattttacacacaaggaaaatgaggctcagagaggatgatttttacaattggaatcatcccaatgtcaattatttatggagttctaatgatgaattccaagcactatggaaatatatgatcttatgttctctccagagtgctgcaaggtaggtacaattatgtcatttagctaataagtaagttacagctcttaaggcttatataactcaaagtcacaaaatcttaattggcagaaccaaagatttatactcagtcttgtctggacctagagttagctcttttcacctcactgtgctttgtatcagtaaaatcaggactaaaatccaagtcacatggatttgagatctcaatagtagtttccttataacacgtttctctgtatcatgttattcccttaataggaaatcaatcaatccgtcaatcaataagaaccgttcatgtccaaacctctcagtttggctttcaggcccttccatgtggtatctatcttgtgaatcactaccacttctgctctctcatcattcccaggacatttaaccagtattgccacattacttgatgtattagttcattctcacattgctacaaagaaatacctgagactgggtaattggtaaagaaaaggggtttaattggcttacagttctgcaggctgtacaggaagcattgtggcatcagcttctagggaggccccagggaacttacaatcatggtgtaaggcaaagggagagctggcacttcacatggcaggagcaggaggaagagagagagcagggaggtgccacatgcttttaaacaaccagatctcatgagaactctatcataagaacagcaccaaagagatgaatggtgctaaaccattcattaaggttccacctctatgatccaatcacctcccaccaggccctgcctctgacatggcggattacaactgaacatgagatttgggtggggatagagatccaaatcatatcacttggcatccatggagacacagacataagatcattaagcttatagatgcaactttagaggcatttgtggaatctttccacaaagatttaactcactgggttgtggtgcattcaattcaattgacttcgtggtttccagtcctaaagagattgttctcatattagtgggagataattacagttagaattccagataaagtttactttaatattggatttaaaaatacaaaagtggccaggggcggtggctcacgcctgtaatcccagcattatgggaggccgaggcagatggatcacaaggtcaagagatcgagactatcctgaccaacatggtgaaaccctgtctctactaaaaatacaaaaattagctgggcgtggtggcgcatgcctgcaatcccagctactcaggaggctgaggtaggagaatcacttgaacccgggaggcaggggttgcagtgagccaagctcgtgccactgcactccagcctggcaacagagcgagactctgtctcaaaaaaaagaaaaaaatacaaaagtaaccaattagactttgattatctactaaattcactgaacaataattgccttcaaatgtccagcccattaaatattaaaacagtcactaaaagttttgatgggagaataccatagcaagttttaaatacctgattcatttgaaatgtgctttatatagtgtttgcatgatttatactacgtttctgagtacaacaactttggccctgactgatttcatatcaccacattttgattctgacaatgtcaataaatgaaatgacttcaagcatccacttagaatatacaaagaaaaaaaaaaggaagctgaggccacccaaactaaatatatatagagagatatatagatatatagattagatatagatataaaaatacagttcacccatgaagggtgaggggtttagtaatgttgaccccaccatgcagttgaaaatttatgtatcacttttgactcagccagaacttaactaataacagccttctattgactggaagccttatgaatagtatagccaattaacagatattttctgtattatatgtattatatactgtattcttacaataaagtagctagagaaaaaaatgttattaagaaaatcataaaaagagaaacatatttactatttattaagtggaagtggatcatcataaaggtctttatcttcatcatcttcatattgagtagtgatatggtttggttgtgtccccacccaaatctcatcttgaattgtaattcccataatccccatatgttgtaggagtgacctgataggaggtaattgaatcatgggggtgggtttttccaatgctcttctcgtgatagcgaataagtctcacgagatccgatggctttataaagggaagttcccctgcacacactctcttgcctgcctccatgtacgacatggctttgctcctccttcaccttccaccatgattgtaagctctctccagccacgtggaactgtgagtccattaaacctctttttcttcataaatcatccagtcttggatatttcttcatagcagtacgaaaatgggctaatacaagtaggctgagaaggaggaagaggaggcattggtcttgcttgtctcaggggtgatggaggcaggagaaaatccatgtctaagtgcccctgtgcagttcaaacccacactgttcaagaattaactgtaatctaaaaagtgattttaaaaaaaaatcttatcagagtgatgaggtcattagagaactagttgaactgagggactcatgaataattttaattttggcagagcatgagaaaaagaggtggaagctataaaggcaggtaaaaagaaaaaactgaaacattcatgaattcttaaaggttaaatgtctgctggcatgaagtgttgaatccctgggagacacagacatgaaagaagaccacacccacttcatagttcttctccatgagccttaattgggtactcatgagaaacactggggacaggtagaagacctgagagaccctcctcagtggtgtgggagttctgagcctgccaaggtttgagaaaatagcaggagtatccagagaagctcattcatttctgggcgctctatgagtacaaggtaataattagcctagaggataagcatgaaacccactcacaccccagagtcttctctgatatggaatgaaagctgcctactggccggggaagggtaagaagaaacttacttgtgcctctgttttgacactaagcaaaagctgccaggggagagactggaaattcactcatacccaatatcccccactgatacaaggtagagttcatctgccacaggagaaaaagttattatattagttttctgggctgccattacaaaataccacagactgggcggcataaacaactggaatttattttctcacagtcctgaatgcttgaagtccaagatcaaggtcctagtagggttgctttcctctgaagcctccctccttggctcacaaatggctgccctcctgctgcgacttcaaatggttgtccctctgtgcatgtctgtgtcccaatctcttcttataaggatactagtcatattgaattggggcccaaacactaatggcctcattttaacttaatcacctctttaaagaccatatatccaaacacagtcatattctgaggtactgggggttgagacctcaacatacgaattaggggagtggagagtgacacaattcagcctataacagtcagtaaatgcactgcactcaatcctgaactgagtaggtgccaaggctacctgcaactagaaggaggaggaatacggagaaagcccaactcctgaggcttaggtgcacaaggtctgcctaagaatgaagctggagcaagagattcaaaaaatgtctaccataagccttgtactgagtaccataagctttgcactgagtaataagcagtgacaatctttcagtggaagagggcaaaagaggaaaaaaggcatggtgaaagttgaggatggggcaaacgacaagagaaaaactctacaggacttcagaatttatactaaacaattgtagtgcactaaatgtaataatagcaacaacaataaaagaaactcagctcaagaactgagtcaactgacccaactccccatactaaaagtttgacagaagaagagatatgcccattctggacattagtcactatttaacttagtttctaatgttattttacccataatgttcagcattccattaaaaataacaagacacacaaagcagcgagaaaaaaaaaaatcctcttgtcaagaaataaagtaggcaaaagaataaaactcaggatgaccagttatagcaaagtttcaggatacaaggttaatcttgtacaaaagtcaattgctttcttatctaccaccaatgaacaagaaaaatttgaaattaaaaacctaatacattattcacattatcatccaatgaatgaaatacttaggtataagtatttgtacaagatctagatgaggaaaaccacaaaactctgatgaaagaaataaaaaaagaactaagtaagtggagagatattctgtgttcatggatgggaatactcactattgtcaagatgtgagttcttcccaacttgatctatagattcagtataaccccaatcaaaaccacagcaagttattttgtggatattggcaattggattctaagatttacacggagaggcaaaagacccagaatatccaacacaacattgaatgagaagaacaaagttggaggactgacactacccaacttcataacttaatataaagctacagtaattaagacagtgtggtattggtgaaagaatagatcaatgaaacagactagggagcaagaaatagagccacataaatatagatcaactaatgtttgacaaaggagcaaaggtgaagaatgtctttttaacaaatgatattagaataactgaacatcaactagacacagaccttacagttttcacaaaaactaattcacagacctaaatataaaatgtgaacctataaaactcctagatcataacatagaataaaatctagatgatctagcgtttggtgatgactttttagatataacaccaaagacacaatccatgaaatgaagaattgataagatggactttattaaaattaaacttttctgttctgcaaaagctctgtcaagagaattcaaagacaatccacaaactgggagaatatacctgcaaaggtcatatttgataaaggactgttatctaaaatattaaaataacccttaaaactcaaaaataaggaaacaacccaactacaaaatgggctgaagccctcaacagacacaagatatacagatcgcaaataagaaaacatacaaatggcaaataagcatatgaaaagatgcttcatatcatatatcatctgggaaatgcaaacaaaaacaatgagggtagtgtgatcaagacgactgactagacataggtctttgtccatagagcagaaccaggatagtaaagtagatactcacatttcaaacagatcatctaggagagaatactaggattcaccagagaagtgatgggaatcaccagaagtaagtgaggagagggttcaaggcagcttgccaggcaagggactagctgagagctgggagaggctcctggatgtggggaaacagtaagagagtaacccccagggcttcacactccaaaacagactattacaatcttggctatgggagaatcctccaacccatcagggcctcaggcctgacatagagagctgcctagagattgcacagaggcattgcgccaggaagggaacacacacagagttccacagacatccaagcctagagcagcttcagctggacaccattttgagaagctagataccacagatctacagacatggctgctgctgttgcacttcttcaaggagggagaggcgagatcaggcactcccacgtaccccatgagaaaatgcctaccactctgtgcagcctgctgttgagattgagacatgaacagactgcacccgccacagcttcttgttcatgctgcttgcctgggaggggccccaccctctctagtctcaaggccaaggcatcaatttgagagtttaatgctgggctgtgcctgccctcaggccaagttgaaggtgacacagctgcagctgccacccagccagaagaggaacaagatggaccaagctctcctaagcatacttaggacaatacccactaccctgctacaggcagctgggggactgagaactatttcaaccaatccatggcagccaccagcaacaccaacatggactaactgggtctaagtgggttggttgctccaccactgctactgccataaagcacaccacacaagctgcccaggggtctgagaacctgcttacacacccagcccactgttcccactactaacttctaaacaagccacgtggaggccaaagaatcaaccctccagggcccactaacacaagagccaaggtaagctgctctggggtttaaaaacaagcacactcaggcaactgctgccaccactggggcccaaagactgactcagttggtgtccaggtccccagcaaaacattaccacaacctcaactaataactgtactctaagatactgagaaaatcacaggtactattgaccctttttcctgccaagaagtcaaacaaagatcaaaccaccacaggcatctaaaatcaaagccaaagtatcctactcaaccaccaacatatatacatctgcagaaaaaaaatcctcccctgcaaaagcaatttcaaaaaattggaacaggcaactactacaacagatattcagatattagtggaaggacacaggaaacatgaaaaagtaaggaccacaacaattgtagtcatagatcccaatcaaaaaggattccttgaaaagccagataaaaactcaaaatattaattttaaagaagttctatgagatgcaagagaaatctgaaaatgaatgcaaagaaatcagaaaatcaattgagtatatgaatgaaaaatttaccaaggagacagatatcattttttaaaaattctgaaaataaaaaatttactgagagaaatacaaagtgcattagaaagctccaacagtaccataaaccaagcagaagaaagaagaaagactctcagaacttaaagacatgtcttttgaaataatccagtcaggcaaaagtaaggaaaaagaataaaaaagaatgagcaaagcctctgagagagtggggctacataaagtgacccaaagttatgaattatctctattccaaagagagaagagagatttaaaaaaaaagtttagaaaacctatttaaggaagtaattgatgagaacttcccaagttgagcaagagagtcacacatccagatacagaagactcagcaatccccaggcaaatcccctttgaaaaaagaactttacctcagtgtattatattcagaatatctaaagtgaaagtgaaagaaagaattttaaaattagtgagagaaaagtggctaattacctataaaagggaatcacatcagactaacaatagacttttcagtaaaatctttacaggctagaagagaatgagatggtattttcaaagtgctggggaaaaaataaaaacacctattagtcaagaattttacatcctgccagaataagcttcataaattaaggaaaaataaagtcttctgcagacaagcaaatgctaaggaaatttgtcaccactagactggtcctacacaaaatgttgaaaggggtcttaaacataaaaatgaaaggtcaatattcaccatcatgaaaacacatggaaatataaaactcatagatcttataaaaacaatcacacaaaggaggaagtgaaaggaattaggctaggcacagtagtgcactcatgtaatttcagcactttgggaggccaaggtgggtgaatcacttgagctcagaagtttgagaccagctcaggcaacatgacaaaaaataaaaaaattagcctggcatagtgacacacacctgtagtcccagctacttgggaggctgaggtggaaggatggcttgagcctgggaggttgaggctatagtgagccatgatcatacaactgcactccagcctgggtgacagcatgagaccctatctcaaaaaaaaaaaaaaacaaaaaaaaaccagccagccatggtggttcacacctgtaatcccagaattttgggaggctgaggcgggcggatcacttgaggtcaggagttcaagataagcctggccaacatggcgaaacccagtctctactaaaaatacaaaaaaaattagctaggtgtggtgacacacatctgtaatcccagctacgtggaaggctgaggcaagagaattgcttatacccaggaggcagagtttgcagtgagccaagatcacaccactgcactccagcctaggtaacagagtgagactccatctcaaaaaaaaaaaaaaaaaaaaaggactcaaacggcaacacaatagaatttcatcaaatcataaagtcaaaaacagaaataggagaaataatttataaaacaacttgaaaacaattcacaatataacagaaaaaacttcccatatcaagactaactttgagtgtaaatggattaaataatactccacatagaagatacagattggcagaatcatttgttgtcatttatttcaatagttctgggagtatgggttgtttttgcttacatggataagttctttagtgatgatttatgagattttggtgcatccatcacgcaagcagtgtacactgtacccaatatgtagtcttttatcccacacccctctcctaatcttaccccctgaatccccaaagtccattacatcattcttacgcctttgcatccttatagcttagctcacacttataagtgagaacatacaatatttgattttccattcccaagttaccctacttagaataatggcttccagctccatccatgtttctgcaaaagagattattttattcctttttatgactgaataatattccatggtacatatgtaccacatgttctttatccactcgttggttgatgggcacataggttggttttatatccttgcaattgcaaattgtgctgctataaacatgcatgtgcatgtgtctttttcatacaatgacttattttcctttaggtagatacccagtagcaggatatctggatcaaatggtagttctacttttagttttttaaggaagctccatactgttttccatagtggttgtactatttacattcccaccagcagtgtaaaggtgttcccttttcaccacgtccactccaacatctattattttttgactttttaattatggccattcttgcatgagtaaggtggtatctcattgtggttttaatttgcagttccctgataattagtgatgttgagcattttttcatatgtttggtggctgtttgtatattttcttttgagaattggctattcatgtctcttgcccactttttgatgcaattatttgttttttttcttgctaatttgtttgaattccttgtgattctgaatattagtcctttgtcagatgcaaaggaaaatttttttccatgctatgggtggtctgtttactctgctgattatttcttttgccgtgcagaagctttttagtttaattaggacccatttatttatttcggttttcattgcatttgcttttggggttttagtcatgaattcttagcctaagccaatatctagaacagtttttctgatgttatcttctagaatttttatggtttcaggtcttagatttaagtcttcgatccatctttttttttttttttttttttgaaacagagtctcactctgtctggctggagtgcaatggcgtgatcttggctcactgcagcctctgcttcccaggttcaagagattctcctgcctcagcctcccaagtagataggactacaggcacacaccaccatgcccaggtaatttttatatttttagtggatacacagtttcaccatgttggccagactggttgatccatcttgagttgaattttgtataagatgagagatgaggttccagttttattcttctacatatggcttggcagatttcccagcaccatttattgaatagggtgttctttccccagtttgtgtttttgtttttcgtatgctttgttgaagatcagttggctgtgtttggctttatttctggattctctattctgctccattgatctacatgcctatttttgtttgtttgtttgtttgttgagacagggtctcgctctgtagcccatgctggagtgcagtggcgcaaccttggctcactgcaacctccgcctcctgggttcaagcaattctcctgccacagcctccctagtagctgggactacgggggcctgccacagcctccctagtagctgggactacgggggcctgccaccacacccggctaacttgtgtttttagtagagacaaggtttcaccatgttggccaggctggtatcaaactcctgacctcaagtgatccacccactttgacctcccaaagtgctgggatttcaggcgtgagccactgtgcccagcttacatgcctatttttataccagtatcatgctgtttgggtaactatagccttgtagtataatttgaagtcaggtgatgtgatgcctccagatttgttctttttacttagtattgctttggctatgcaggttttttggttccaaatgaattttaggattgttttttctagttctgtgaagaatgatgatggcatttagatgagaattgagttgaatctgtagatttctttgagtagtatggtcattttcacaatattgattctacccatccatgagcacaggatgtttccatttgtttgcatcatctatgatttctctcagtagtgttttgtagttttccttttagagatctttcacctccttggttaagtatattcctaagggttttttgttggtggtggtgtttgtttgtttgtttgtttgtagctgttgtaaaagggatttagttctttatttgattctcagcttggtcactgttggtgtatagcagtgctactgatttgtatacattgattttgtatcctgagactttcctgaattcatttatcagatttaggggctctttggatgaatcttaagggttttctaggtatacaatcatatcatcagcaaacagcaacagtttgacttcctcttttccaatttggatgccctttatttctttctcttgtctgattgctctagctagagctaccagtactgtgttgaatacctattcaaccttgtcttgttccagttctcagcggcaatgctttcaatttttccctattcagtatgatgttggctgtgggtttatcatacatggcttttattactttgtggtatgtcctttctatcacaaagggtttttatgataaagggatgctggattttatcaaatgctttttctgtgtctattgtgatgatcatatgatttttgtttttaattctgtttatgtaatgcatcacatttattgactagtgtatgttaaaccatccctgcatttctggtataaaacccacctcatcatggtggattatctttttgatatattgatgaattcagttagctagtattttgttgaggatttttgcatgaatgtttatcaggaatattgttctgtagttttctttttctgatatatcttttcctggttttggtgttagggtgatactggcttcatagaatgatttcgggagaattctttctttaccttttggaatagtttcagtaggattggtaccaattcttctttgaatgcctaatagaatgcagctgttaatccatctggttctggattttttttgttggaaatttttaaattaatgatttaatctctctgcttgttattgattggtctgttcggggtttctattttttcctgatttaatctaggagagtggtatattttcaggaatttatccatctcctctagattttctagtttgaatgtgtgtatgtgttcatagtagtcttgaatgatcctctgtatttctgtggtaccagttgtaatatctcccatttcatttctatttgaagttatttcaatattctctcttcttttcttggttaatctcactaacagtctatcaattttgtttattgtttcaaagaaccagctttttatttcatttatcttttgtattttgtttgtttgtttcaatttcatttagttctgctctgacctttgttatttcttttcttctgctgtgtttgggttcagttttctcctgtttctctagttccttgaggtgcaaccttagattgtttatttgtgcctttcagacttcttgatgtaggcattcaatgctatgaacctttctcttagaactgcttttgctgtatcccagaggttttgataagttgtgtcactactattactaatttcaaataattttttaatttccacattgaattcattgctaacccaaaaatcactcaagagcagattatttaatttccatatatttgtatagttttgggggttccttttggagttgatttacagttttattccactgtggtctgagaagatactcaattggatgctggttttcttaaatttattgaaacttgttttgtggcctaccatatggtataacttggagaatgttccatgtgctgataagaagaatgttttacaaatatctgttaagtccatttgttctagggtatagttttagtccattgcttcttgttgtgggaagttatggacccctaatggagggaccagctggagccgaagcagaagaacataaattgtgaagatttcatggacatttatcagttcccaaaatgaatacttttataatttcttatgcctgtctttactgccatctctgaacataaattgtgaagatttcatggacatttatcacttccctaataatactcttataatttcttatgcctgtctttactttaatctcttaatcctgttatcttcgtaaactgagaatgtatgtcacctcaggaccactagtgtacaaatggattgcagaacatgtgtgtttgaacaatattaaatgtgattgtaaaacatgggtgtttgaacaatatgaaatcagtgcaccttgcaaaaaaaaaaaaaacagaataacagcaatttgcagggaacaaggaaagataaccataaggtttgactacctgtggggtcgagcagaatacagccatatttttcttcttgcagaaagcctatagacagatgtgcaagtaggagaaatatcactgaattcttttcccagcaaggaataaccctggggaaggaatgcattcctgggggtaggtctatagacggccactctgggagtgtctgtcttatgcagttgagataaggactgaaatatgccctggtctcctgcagtatcctcaggcttactaggattgggaaattccagcctggtaaattctagtcagactggttctctgctctagaaccctgtttcctgttaagatgcttatcaagacaatgcgtgcacagcaggacacagaccctcatcagtaattctaattttgcctcagccttgtgatccttattgccctttgaagcatgtgatctttgtgacttactccctgttcatacacctcctccctttttaaaatccccaataaaaacttgctggttttgcagctcagggtcgccatcatggtcctaccattatatgatgacacccccggaggcccagcagtaaaatttatctctttgcactctttctctttatttctcagaccggccaacacttagggaaaatagaaagaacctatgttgaaatattgggggctggttcccacaatagtttctttttgactttctgttttgatgatctgtttattgctgtcagtggaatactgaagtcctccaccattgttctgttgttgcctatctaatttctcaggtataatagtaattgctttataaatttgggagctctggtattaggtgcatataaacttaggattgtaatatcttcctgtcagaccaatccttttattattatataatgtctttcattgtcttttttcactattgttgctttaaagtctgttttgtctgatataagaatagctactcctgcttgcttttggtttttccatttgcgtaaaatgtttttttccacccctttaccttaagtttatgtgagtctttatgtgttaggtgggtctcttgaagacagtaaatatttagttggtgcatttttatccattctgccattctttatctctcaagtggagcatttgggccatttacattcaaagttaatatggagatgtgaggtgctgttctattcatcatgttagttgttgcctagatactttgtttttttcattgcgttactgttttgcagggcatgtgagatttatgctttaaggaggttctattttggtgtatactgaggttttgtttagtgaattagaactctttagcatttcttgtagtgctggtttggtagtggcaaattctctcagcatctgtttgtctgaaaaagactttgtctctccttcaattatgaagcttagttttgctgcatacaaaattcttggctgacaattattttgtttaaggaagctaaagatagtacccaaatcccttctggctggtaaggtttctgctgagaaatttgctgttaatgtaataggttttcctctgtaggttacttgatatttttttctcactgctcttaagattctttccttcattttcacactagatagtctgatgactatgtgccttggggataatctttttacaatgaatttcccaggtgttattgagtttcttgtgtctggatgtctagctctctagaaaggccagggaagttttcctcagttattccctcaaataagttttccaaacttttagatttctcttctccctcaggaacaccaattattcttaggtttggccattttacataatcccatatttttagagactttgtcctatttttattttctttctctgtctttgtttaattgggttaattcaaaagccttatcttcgagttctgaaattctttttgctacctattctagtctattgttgaaactttccaccgcattttgtatttccctaagtgtatctttcatttccagaagttctgattgtttctttatgatatctatttctctgaaaaagttttcattcatattctgaatttttaaaaattctttaagttggttttcacctttctctggtatatccttgagtagcttaataatcaaccttctgattatttatctggcatttcagaaatttcttcttggtttggatccatttctggggaactagaatgatcttttgggggtgttatagaaccctgttttttcatattcaaagaattacttttctggttccttcttatttaggtagactatttcttcaaattattcttaattttttttgttttgactgtggggtttttttctatttctgtttttcccccttttaaggatcagactttctgactttaatgtttacagtttattttaacataatttgattcctggtgcttttagggggaaaacactgtatgagttcctttatcatagagagtctttgtgctctggttgtagtagttaggtacttggagtgtgggccagttcactgtgtcctatggggctggaatggtagcaatctcttgaggcttatctcattctctcatagtattcactttatttgtttaattgttcccagtattttatttactgagttgatgattcaggcttcaggccaataagggaggtatccttaggtaggcactggttgtagctaaagcaggtttgtagatataatacccactggagagcagaagtcccacccttgatgaatgtggctagggaagctctcaattagatgttcagagattttatcaaaatgaagagtgggagatacctcaattcccctgccaggccagcaggtaggctattcacctcacagcctcactcctgtcccagtgttccagctattcagatcatataagcacctcttttcattgtagaaatgttaatcttccaactatggaggaattgtgactctgcttctcatgcaggcctgaatctagggagtgctcctcctatggggctacaatcaccctaaattgtaccaggaaggctgcctacagatgcatccatgcttcattcccatgggagaagccccagctgtgtctgcagtagtgtgccgggggaacaaggaccccttctccaaggccctttatgatcacagaggctgcctgccggttgacataggcatacagattttccctactgtgcccagctctgcaactgtgtctctgctataagaaacttcccaccagtagaaagatctgggactaaaggcccaccatttggattattttgtcccatagggtgatccattgatgtggtgctctcccacttccgccaggactagggcttcctgagagctggactgcagtggtaattattgctcttctgggtctagcccaccagtgggactaccaggctttgggctggtgctgaggaatatttcaggtctcccagcagtggatacccagcatctgctctgatagtgacagcaggggagtgacgtagactctatgagactccttggttgtaaataggtttagcatgctggatttctcaaatgccagttatgctagcagtgaatttgtgacatggacagactcaggacctctggttagccagcatgttgcaggcatcattttctcttccctgggtgcagtgttattctgttgagaggtgctgtaatggcctgagttggttggcctccagctgggaggtagcacttgcaaaagagtaccagctgcattactagcagtaggatttaagcttttcctaaattgtccaggggaagtattctagcttctcaggcaatggatagggctataaagctcccaaaagtttatgtctttgtgttaagttaccagggcaggtagagaaataccatcaggtagggtcaggattaggcaggtctgagctcagactctccttgtccggggcctgcctcagccactgtggggaacagagggtggttcccaggccaccaggataatgttccagaagaaagtataactgtctctactgtgcagaagagttcacaaagggagtgaggattagctgacagcagtaggtcccacccagctcccacacagttggtgaggctggtctcactcccacagtgtcccgctaacagcaccaggtttagatccaggcagtctgcacacagaactcagacctgacccaagccataagctcccccagagagacagcaataacagctttaaggccattcccttccccatctgcccggaaggcaggcacccagcttctgtgtttgcgtctgcagcatacttcctgctcactcctggattctgttcaagagagtttgttcccactcaaaattatatcacaaaattcagttgggagcttctttcactctgtgacccctccctgggttcattggctaacttccgcaagggtacctgtgggaaataatcaggaatagcttccctgggctcatgctgcagattgtgaatgcctacaaggcacttcccactgctgcttctactttaatatctcacttttctccctaaatttgttccagctctcagtagggttaaggccttctcccatgatctgggttttcagattccccagtagggatgtgtgtttagatgcaggttctccccctcgcacactctgggaacttttaatttttcacctatctcatggagtaggcctgctgcttctttcaaaggctctgtgaattctttcagttttcctgacaagttcctgtggtaattcatggaaaaaaaattaacagtatgaatctccacccactattctgtcctttcaagtgggagaaggacactaacactacctcctatccactatcttgaaaaaaaacagaatgggtttttttaatgatccaagaatatgctgtctacaagaaagtcatcttatccataaagacacacatagactgataaaagtaaaggtatggaaaaagatattccacacaaacagaaaccaaaagtgaacagaagtagctatacttatatcaaataaaacaagttataaataaaaaatggtaataaaagacaaagaaggtaattatataaagataaagggatcaaatcagcaggaggatataacaaacctaaatatataggcacccaacatcagagcacccaaattcacaaaacaaatgttactagatctaaagaaatagacaacactataataacagtgggagattttagcactccactcatagcactagataggtaattgagacataaaattaacaaagaaacattgaacttaaattggactttagacaaaatggacttatcaattatttatatgacatgctacccaacaactataaaatgtaccttctttttatcagcaaatggaatattcttcaagatagaccatgtttaggccacaaagcaagtcttaacaattttttaaaaataaaaatcataccaagtatcttctcagactacagtggaataaacctagaaatcaataccaagaggaacttcagaaactattcaaatatatgaaaattgaacagcatgctcctgaatgattactgggtcaataaagaaatttaaatggaaaatttaaaaaaattaaaactaatgaaaatgaaaagacaacataccaaaacccatgggacactacaaaagcaatgctgagtaaattttgcagtattaaatgcctacatcaaaaaagcagaaagatcacaaattaacaacctaatggcacacctcacagaactagaaaaacaagaacaaaccaaacccaaagttagctgaaggaaacaaataacaaagatcagagcagaactaaataaaatgagaccagaaaaaaagatcaatgaaataaaaaggtggttgttcaaaaagataaacaaaattgataaaccactatctagattaatcaaaaagagagaggatccaaataaacacaatcagaaatgaaaaaggagacatcacaactgataccacagaaatacaaaagatcatcagagactattatgaacgactatatgttaacaaactagaaaacctagaggaaatggataaattcctggaaacatataaccttccaagattgatccgggaagaaataaaactcctaaacagaccaataatgaatagcaaaatttagtcaataatttaaaaaatcttcccccaacaaaaaagcccagaaccagatggattcacactcaaattctaccaactatacaaagaagaattaatgtcagtcttcctgaaactattaaaaaaaaattgaggaggaaggaattatccctaattcatgctatgagatcaatatcaccctaataccaaaaccagacaaggacacagcaaaaaaataaaactatagatcaatattcctgatgaacatagatgcaaaaatcctcaacaaaatactagcaaatcaaattcaatagcacattacaaagataatactcaccaggcattgcagcttacacatgtaatcccagcactttgggaagctaaagcaggagaagtgcttggggccaggagtttgagaccagcctgggcaacatagtgagaccttgtctctactaaaagtttcaaaatcagttgggtatggcagtgcacacctatagtcccagctactcaggaggctgaggcagaaagactgttttgtagcaggacgagctgcagacaaaacccctcagacaccgagttaaagaaggaagggctttattcggctgggagctttggcaaaactcaagtctccaaaaaccgagctccccgagtgagcaattcctgtccctttaaaggctcacaattctaagggggtccacgtaagagggtcatgatcaattgagcaagcagtgggtacatgactgggggctgcatgcaccagtaattagaacggaacggaacaagacagggattttcacaacacttttccatacaatgtctggaatccatagctaatataaccagttaggtcaggggttgatctttgaccaggcccaggtgcggcaccgggctgtctgcctgtggatttcatctctgtcttttagtttttacttctttctttggaggcagaaattgggcataagacaatatgaggggtggtctcctcccttattccccccctttgagaatctcactcaatagtgggagttctcattttcattttcactatctatgtcttcttgcaagacagatcaatagtgattcatatagcacacttgtgctgaagcattttggtgaactaaggtagcaatgaagctttttatcatttgaagaagtacaggtagcaaacaagggagcaataagcaggtttttattactattataactcttattataagagttttaaatctttttagtgctgggaaccattttccaaacatagccttaggatcaaatccatgctacacttgcacgggcacatgtgccagttttgccatatttctaactatgtcttcaactacttgcctttgatcacctatatgtagacagcaattagtaaggttaaattttctacagacccttctttcagctgctagcaagtagttgagagctaatctattttgatagatagcgtttctcatctgagtttcttgccaggccagaatagtcaaggctttgccggtcttaatagtgattatttctaagacagcttgtaaccgtatgattcagttgagcatgtaaatgggggtcaggtatcctcacaagctgtcttgtgcccaagtaccaggcatataatattgtatgatcctctcagggggccatttatcatctttttaattttttatagctatgcttttctttttgtgggaagcacagacaggaaagcctaggagttcacctgtctttatgggcagtaggaagaaagatggtttaatagtgccaataacacaactacctgcctactggttgggtaatttggtgtaagccctagacccccatatccactgtaatccagtaggggctgtccagtcctggtgggactccgggtgggttcacacagtttgcaactttgggaatttactaaatggatttttcttagcatgctttgaactccactaggtggctgtttttgtagtattattatagtttttgcctaaggcagctgagtcttcctacaggaagggtgaagtccttcctcacttttgctataaagtattgtctactgattgaggcttttaggacccagaagttatcagggtgattcttctgagctgggaattcatcaggaactggatctgtaggtactaatcctcgggctttccatggccattgatctcctattacagttctacatacataacatgaaatgacattgagagactgggctacatgctcagctaattgcaaaaacaaatttcttgtttttcctggaatttctggtactggcacattcagtttatcacagaaggtttgaaatactggctcaagagagcgtttataaacttctcaaaccatgatatttactcgaggatccagtccagccctatcgattcctagggttacacactccccttttttccagcaaggatcaagggggttggttattactagttctaaggggttaaactgaccactggtataggaagggccacttttttttttctgaggatggacaggatcctttttattttttatgtaagtagcctaaacgacataaaaccagtatccacatttatttttacacagtcctagttcatgacaaatgtacttattttctgccatatagcctcttttttaattaagagaaccacatcttatttctaacttattactattaatgacagcacaggcatcaaacttcaaggtgacttgtttgggcacccctttttcttttgttttggctaacactttactcgtatcatttatgagcctttaccagtcctcagtccttaatcttatttcaaaaactgtgttcatgggaggctcggatgggtcataacacacatcaggttggtcatttcctgggctacatactgttaatagaatagcattatacaaacaagttttttttttttttagagtcccagtacacttataataatcataaaataataggactgtagcaactttttgtcctacatcagtgacttgatgtatacactgggaacagtcctcagtctgagaaaggtcagttaaaatccttactgtacaagtccaaattttaaggaaaatgagtcccatgatgagttttctcatgcttctgccatgtgtggaccagtcagcttctggagcagggctagtcatcttcttcagagtcactttgcagggattggtgaagctgctcccatccacgtactgctcacagtctactgatgttcaaggatggtttcagaggttgggcctgctagaataaactgagtccaacacctctacacagttatgttcaactggactctctgatacagggagcaaggtggtggggtttagggtgttgcaaacttcaatggttatgcagagattttcacatagcaagctttggtacttggttaatctagcatttgttaaccagtgacgtccttcggtagtcattaaagttaccacagcatggggggcctttatattcaggttttgcctaagggttagtttatctgcttcttgtgctaacatggctattgctgccaggcccttagacatgggggccagcctttggaaaccccatctagttgttttgagagctagaccactggccttggccagggccccacagtctgggttaaaactccaactgccattttttttctttctgatgcatagggtgtaaagggttttgttaggtcaggtagccccagggctgtggccgacatgagtttttcttttaactcatgaaaagctcattgctgctggtcgtaatagatgtagtttatccaatttacatttttattaactgtcacccaccaaaatattgactcaaatcctgcagctatttgatttcaagctttaaattgatctggtatttcccgtggaaatctaattgcatctaaatggatgtgagagtctaaagaccaataaggggtgtctctcgcttcatgatgtcttatttttcctccctctggttgatgaaatgccagggtgaaagggatagccaattggactaaagtacaagtgccactccagttattcagcagagtgcccaataaaggtccaccacaataacaccacacatctgctcagggatgaataagggctgactgattgataagctcttgaaaatttttaagctcactgcatctcttcaggtctccaaggaatgttaagtttcctccctgtggtgagagacatgaagtgaacttagtgttgggagacggaggctggatggccctcaggggctgacctgcaaggtgctgaactttgggatatagcagagagagcttggcacaacttattactccaggctgtagaatcctggaaaagagccaccatgcagcccatgcctggtcgactggaggaccaccctagaggaaaggggacaatctgggcctctggtctgccatgtgcacaagcataacaattgcttttgtttaacctgcagatggaatatttgatccattccaaccaggcatttgcaacttggtatgctgtcttaattgccaaagtttgttttaagtctttaacttctataatcctctagtaaaatgaatgtgtgattttaggaaattataaaaaccagttagggcagtccatccttgctctttagttgtccacagaacgttggaccaactatggcataaaagctgtacattggggggcaagactcctggttgacactggagtctttatcgaaatttccccagattaaatggtcctaatttactaatgcccagtctgaggagagtcaggaaggacagaagtacttttctgaagtagagagctgtctttgacttggcaagtccccacagggtataacaaggcaagcattaaatgcaatagtgtgaggcgaaattgacttggttatgttaataactagatggtcagcaatagagcaaggaaagaagaaagagtaatagaatagatgaaagagttaaatttttcttagctttagtttgataaggttttcccctgggtctatggcccacgactctggagggggtggtgctttcttgactcaggtgtgatgagtccatccttctttcactctatgaacagcagtctcggtggtcagcagcacaaggtagggtccttcctaggctggcttgagtttttcttctttctaccctttgatgagaaggtgatcttcaggctagtgatggtttactggaaattctaggggtggtacctgtgctaaaagacttttagttttgacggaaaggaaagtggaagataggccaagtacataatttctaagaaactgaccttttgttttaaatgtggggacatcagtggactttatagtccttggtgccttcttactgagaaatttcttttagcacctatttttattagtttttagaccaaagaaagccaaacatcattttatatttaataatgcttcttgtatgatttttataccagataagctaaatttcacctttatattagtgtgctattaatgttaaacttagttttaataaaatttgtatacatatttattcaatttttaatgttggaccataaggtaagatttttatagactctttttaaccttttataatctttgttaaagagcaggttagtgctttaagaaaaacccattgtatttttactttaatgtccagttcacagaaaaactggatgatagctttttaacttcagcaaatatgtttacacacagaattttctttacaattaatgttttaaaacttgcttaaaccttcaaaacaataacttttttaatgttttaatgtaggtaaaaatttacattcttatgcctctttataatcctcttactaaaggtatattttaccttccttatacaccatgcacataaactgttttctttctcaatagtttttaccttcaggaggcctagttacttttaaattatacaacatttcttgcataaattctttttttataatatttttctctttcacgactttagcagacaattcttcgacatgcctcaactttctgacttattacaaacatttctttttttaaacaaccagttaatttatttcaggataagaatttaccatataacattctttttacataaattctgcccccactttttttccttttttttttccaaagacggtaaccattctttgctttatgtctgtggactagactgtctaaggccacaagattagaagttactataatacatgttacactgttaacttttagcaaactttacttttgttgaaaaccatgtaagcttgggattttaattatcctttgctatgaataagaccttgttttgtccaaattaacttagaattcgtatagatggctttctttttccttcaattacctgggaggaaccatccattgtcctgtcctgaagggagttcctcctaggtctggttggacctttgtatggtaattaagatttagatcccctgttaggaaacctgctgggttaagggaattttcattggttagtgttaaattatccttttttttttctttttaggatacttctgaactggtgaggtgtgctcacaatgaggtttcctctcaaagttattttttttactttcttctgttagcaaagcagttgccactacagattgaatgcatctgggccatctgtgggttactgggttaaggatttttgataggaaggcctcagtgcttttgggatacacccttgtttacactgacaacaaagtggtattagagtgttatagggttacggagaatacctttaattatcaattataggttttaaatttaccttggcttttaaaggaatagggtgcactgttttttttttttttcttaactacttgtatatctctttctttctctctttgattttctgtctctttttctctttgactttccttttgcctctgtctctttctctctctttgcctctctctttctctctctctctgctggtctttccttgcctctgccagctgcttatgctgctgttctctcaaccactgttgggggggtgtttaaaatcagtgtaaccaagtgtctatatacaggaactggtctgggtgacctggcttacaggttaccttgtgccatacctttgaaacaaaggacctgtccaggcttccttctgatggccaacctacctctaatgctggccagtctatttacacaaagttctaagttttcctggtgtcatagtaacaccataatctcctttaaatcctttcttgaaatttttcaacatagttcctagtggggtgggcttactttgtgcctgacccatgcttctttgagacaaaacaccatactcacaccacacacacaccacaaaacaaagaacgggtaaaaagagcacacacacacttttacagtttacaccaaagcagaatcaaaaccaaaatcagagtatcaagaaatccaagccaggtcaaaaccaaaaccaaagtattaagcaattcaagtcaaatcaaaacaaaaaccaaagtgctggtataggcacactgtgggtgatcaggccacgcttccactcaaatggagagggcaagttccaaagactagtcttacgaagtttcagatgtccggactccaagtgtcagttccttcccagtgttcagtcactgcattgatcctccatgagggcctgccatgtgctgctctggcgaggcattccaccagggcaattgcctacccaggggtgctctcaggatccgtgtcgcccaagctggctggagtcccccgcagggacacttcacagggcaggcctaagccgtctaagtggctgccttgaccgtccattaatcaccttgcttcccagtcagggaaccaagaaatgtagcaggacgagccgcggacaaaacccctcagacactgagttaaagaaggaagggctttattcggctgggagctttggcaaaactcacgtctccaacaaccgagctccccgagtgagcaattcctgtcccttttaagggctcacaactctaagggggtctgtgtgagagggtcatgatcaattaagcaagcagtgggtacatgactgggggctgcatgcaccggtaattagaacagaacaagacagggattttcacaacacttttccatacaacgtctggaatctagataacataactggttaggtcaggggtcaatctttaactaggcccaggatgtggcaccaggctgtctgcctgtggatttcatctctgccttttagtttttacttctttctttggaggcagaaattgggcataagacaatatgaggggtggtctcctcccttagcttgagctcaggagtttgagcttaaagtcagctatgattgtgtcactgcactccatcatgaataacaaagcaagatcatgtctcaaaaaaaaaaacccaaaaaacaacaaaaaaagaggatgcaagaatagttcaacatacacaaatcaataaatgtgatacaacacataaacggaattaaggacaaaaaacatgtaatcatctcaatagatgcagcaaaagcatttgataaaattcagtaccccttcattataaaaatcttcaaccaactatgcataaagaaacatacctcaacataataaagcccatatatgacaaacctacagcaaatatcacacttaatggggaacattgaaagcattccctctaagaactggaagaagacaagatgcccactttcaccactcatatttaacacagtactgcaagtccttgccagagcaatcaagcaagagaaataataaaagctatctaaactggaaaagagaaagtcatattattcttgttcacttattgattatataatcttatatctagaaaaccctaaagactccaccaaaaaccttttgcatttgataaatgaactcagtaaagtttcaggatataaaattaatatgcagtagcatttctataatggtctatccatggaccaaattaagaaggcaatcccacttataatagctaccaaaaaattaataaaatatctggggatatatttaaccaaggacgtaaaaagtcttttaaaggagaattacaaaatactggtgaaagaaattatagatgacacaaaaaaatggaaaaacatcccatgcttatggattggaaaaattaattttttttttgagatggagtctcgctctgtcacccaggctagagtacagtggcatgatcttggctcactgcaacctccacctcctgggttcaagcgattctccagtctcagtctcctaagtaactgggactacagacatgcaccaccatgcctggctaatttttgtattttcagtagagacagagttttgccatgttggccaggctggtctcgaactcctgacctcaggggaaccacctgcctcagcctcccaaagagctgggattacgggtgtgagctgccgtgcctggccaaattaatagtcttaaaatgaccacacagcccaaagtaatctacaagttcagtgcaatccctatcaaaatgccaatgtcatgtccacacaggaggtctaaaaaaagtaccaatgtcaattttcacagaattagagtaaataattcaggattcagagttagaagaaatgaattcatatggagccaaaaaggagcccaaatagccaaagtaatcctaaggggggaaaaaaaaagctgaaggtatcacattgcctaacttcaaattatattacaaggctatagttaccaaaacagcatgatacttatataaaaatcaacacatagattaatagaacaaaatacagaatgcagaaataaaaccacacacttacagccaacggatctttgacaaaattgaccagaacatatactggagaaagaacatccttttcaataaattgtgctgggaaaaatcgaattgccatatgtggaagaatgaaactggacccctatcactcaccaaatacaaaaatcaactcacaatagattaaagacttgaatgtaagacctgacactataaaaatgctagaaaaaaatagggaaaactcttgtagacattgggctagtcaagaattcgtgaagaacacctcaaaagcacaagcaacgaaaacaaaaatagacaaatgggacttaaagttaaaagcttctgcatagcaaaagaaataatcgacagagtgataaacaatctgtggaatgggagagaatatttgcaaacaatacgtccaagaggggactaatatccagaatttacaaggaactcaactcaacaacaaaaaataatcccattaaaaagtgggctaaagacatgaatagacatttttcaaaacaagataaacaaatagccaacgtgtatatgaaaaaagttacacattactaattatcagagaaatgtaaattaaaaccacaatgaaatatcatcttacaccaatcagaatgactattactaaaaagataaaaaaataacagatgttggagaggatttggagaaaagggaactcttacacactgttggtgggaatgtaaactaggacaacctctatggaaaacagtatgaagatttctcaaggaactaaaaatagaaccactatacaatccagcagtcctacccagctgagtatctacccaaaggataagaaatcactatatcaaagagatatctgcactcatatgtttatcacagcattactcacaatagcaaagatacggaatcaatctaagtgttcatcaatggaggactggataaagaaaatgtggggtatatacacaatggaatactattcaaccataaaaagaatgaaattatatcttgtgcagaaacatggatagaactgggggccattttctgacatgaaacaacccatatacaaaaagacatgttcctcatgttctcacttataagaggaaactaaataatgtgtacacacaaagcagaatgtggagtctgggataatgaacaatggagactcagaaggatagaaggttggtgggtgatggtaggttgcttggtgggtacaatgtgccttgctctagtgataaatgatgcactgaaggccctgacttcaccacagtgcaatatgtcaacagcaaaattgcactttacccaatgaatatatatgaataataaaacaatgagataccactacatacctattagaatggcaccaaaacacaggcaccaccaaatattgacaaaaatgtggagaaacaggaactcccattcattgttggtgggaatgcaaaacggtatactactttagaagacagttgggtagtttcttaccattcaactcggcaagtgctcttggaatatttacccaaagagcttgaaaatttatatctacacaaaaacctaaacatgaatgtatacagcagctttattcataattgccaaaacttaaaagcaactagaacatccttcaatacgtgaatggataaataagctatggtatatccagacaattaagaattattcagcactgaaaagaaatgagctaataagctatgaaaaaacataaaggatatttaaatgcataaaagagtgaattttctcatatttcaattatatctcagtaatttttaaatctctttaaggatgttatcattagaataaactgagtaaaaggcacacaggatttttctgtggcattttatacaaatgtatgtgaatttacagtgatttcaaaataaaaagttttgaagaaataaattttttaattatgagattttaaaaacctccttaagagatgcacaaagaagaaaaaatgagaagaaaaaggttacactaaaaatcagaactcaggaggagtgtggatcacaaccatgggttcagatttcgagatgatttacccaaagtcatattcatgtgagagatgaagatggcttcttcattctgaagttgctcaagttgtcaacagaaatctgctgccagtgatgactcaaaatgttccccaagatttggaggaatcccacaatcctcagcaacacaccacagcttgaggtctttccccaaaagctcatggtggcagttccttatgagagtcaagtcaatctgcaaccattccaaatctcccagctgtactttccaccaatgaagaagaccaacccaggacaaatggccttgcctaatgagagactggtgaaccacaaaaacacttcccaaaaagtccacagggtcacaaagtggcagagctgtccatgacagttgatgaagttcctcttttgggttccacatatgcctaacagacttcctccctttggtccagcagcctcagctccattaaccacaggtgggcatcactatggactaagtggggtggggcattctggcaggaagcaaaggggtaaacagtcaaagagagtctgaacttcagtttgggaaaaaggccttctctacacccatctagaagccagaacttgattttcatcaaaagacttgagtttcatctctgctcagttattgtggaaccttacaaaagttctttaacctgtttccccacctctgttggtgataataatacctctcaggaaatattaagatgacacctctcgagaaatattaaaatgcaatgaggtcatggatatccaaatactggatttttccttttccttaagtcagtgtttcccaaggtgtggcctacaaactattaatggtacataagaaaattttagattaaaatagactttttaattttaatccttataaacttgacttaaacgatactagaaaaaaacataactagcttttctaccttgctaagattaagtttaaaactgagtcaaaataaaatctacgttaaaaaaaattaggttaataatttctagctgggcacaggggctcatgactgtaatcccagcactttgggaggccgaggcggtcggatcacttgacgtcaggagtttgggaccagcctgaccaacatggtgaaatcccgtttctaccaaaaaaatataaaaaattagctgggtgtggtggcgcccacctgtaatcccagctatgtgggaggctgaggcaaaagaatcacttgaacccaggaggtagagcttgcagggagctgaaatcatgccactgcagtccagtctgggtgacagagtgagattccctctcaaaaaataataataatgataataataataatttctaaaatttagtaagtatatatggcagaaataataaagacaattgaaatttgagaaataatgcttccacctataagaaccaggcctgtgaacctcatccttgggtctcctggaaggaggatcttcaggccttctgtattttataatacagtgctctctttgtaagaacccagggacacattgtttctggacatagtgttagatgtagttgtacttttcctaaacatttgtctcgtggatattgcaaaactgtagttggttgagtttctctatttgcactgacaacaagaaagcttaaagcccaacccaacttggggctagttgccaaatacatataggactgtgtcacattcattttttttttatttcaatagttttgggggtacagatagtttttgattacatggatccattctttagtggggatttctgagattttttttttttttttttttgagacggagtcttgctctgtcacccaggctggagtgcagtggcgtgatcttgactcagtgcaacttccacctcccgggttcacgccattctgcctcagcctccgaagtagctgggaccacaggtgcctgccaccacgcccggctaattttttgtatttttagtagagacagggtttcaccgtgttagccaggatggtctcgatctcctgacctcatgatccacctgcctcggcctcccaaagtgctgggattacaggcatgagccaccacgcccggccggatttctgagattttgatgcacccatcacctaagcagtatgcactgtacccaatatgtgtagtcttttattcctcacctccctcccactcttccctctgagtccccaaagtcattcttatgcctttgcatcctcatagcttagctcccatttacaagtgagaacatacaatctttggttttccatttgtgaattatttcacttaagataatggcttccagctccatccaagttgctgcaaagtccattattttgttctgttttatggctgagtagtattccacggtgcagcatattcattatttattagcctcatttctaactccatttaatgtccctatcttataatttttgtttcttttctactttattttattttatttatttttgaaacagagtctcactctgtcacccaggctggaatgtagtggtgcgatcttgactcactgcaacctccatctcctgggctcaaacgatttgcctgccacagccacccaagtagctgggacttacaggcatgtgccaccatgcccgacttttgtatttttagtggaggtggggtttcaccatgttggccaggctggtcttgaacgaacccctggcctcaagtgatccacccacctcagcctcccaaagtgctgggattacaggcatgagtcaccgcacccggcctctcttccacttttaacttaaattgtctcttatatgtttatattcttttaagctatcttaaatcttatttgaaatatggcaaaatgtaaagttttaaacgtcccaagtttattttctttttttgtttattaaggagatacttctctaagtaaagtttgtcctaaaattcaaaggattgtgctttctgaatctttctgtatccctgggttagtacagattcgagtatgctttgataagagtggaacgatcaatcatttggtatcattttaaaattaatccttaccaaaagcccattcttttcagggttacatcactacagtacaaaagagatagttattaacttatttcagacctgggcaaccccatggacctaaagtcaaaagggaagtgggttctgtggtggaattggacttcctcctttttcctcaaaagccaggattttactgacaaaaacaacaacaataaaaaaacccaacctaaaatgataccaaaatctagtgtcagaacattcagaataccctaagaggtgggaagctattttattcatagttcatatactgagtctcctaagccagtagacttttcatgacctagctccttgtacctaccaatgttttctccagtgagagaagatctaatgtttgtcttggattaactcctatactttttttagtatcttggttacatattttttctgagcctcattttctctctgtaaaataaagataatttttattctgcctatttcaatataaagtcacaatgaaatactagtcaggactctcagttgcatgtgacaaaaattcaactcaaattacccaagagcatagctagatggcggtggcagtggagttattagaagttatttagatgaagactgaacagccaaaacagtgcataaaggtagagctcagagaccagaaatggaaatgccaccttacactctttgcatctctcatttctgtttaaccccacagggcacctcattctttcttagaatagaccaaccaggaacatggccacccagagctctagtacctcaaatcttacaacacagaagcaaaacccatagaagaattgagattcactttttctagtctcaaatgcaaatatcctacaaattgatagaattgaccaatcttgggtcaggtacttatcactgaactcaccaactgtggacataagtttgagtattctgattagcctggactaaatcaagtgcctatctctgagccaatcaacactgtctaggagaaagagctctaaaaagatggcagctcccattcaagtcacatgattagagtgaaaagcaccagcatttttgcagagaaacagaagatggaaacaggtggactcttatgggcagaaaaaaaagagagacttattataggtttttaaaatcaggattattagacacatatagtacatggtttccaagtgactcaagactcacaccaagtgccaactactccaagaatcctttcctgataactattttcaattataaaacccttccctcattggcatacccattatagttctgcaaaatataacttccactcagttatatttaagttttcatttgattatatgttatattaaattgctttctaacaaactattttaaatttgtcttcttcatttggttattccctgatgatagaaatcagctatttcttgctggtcatagtgattgtgttaatttatttttgctcccatgaaggatatttgcattttacctgggtctatcacaggcaaagtcttaacccaaaggagtgattgtgacactgggaatgttaaacatacacaacagaacatctttgggattctacactcaggcccaaatgctgtgaaatcattaatataaccctattatattaatatattcattgtcatcatctattttgggctgctgatagacctatggcaatcatacatgcagaatatattatctggggagaggtagatagcattgtgttgcggtaaagaccacaagttctgaagccagacagacctgaatttggcctgagttcttccacttatttgtgtgactggagacaaattactccacatctctgaacatcagtttcctcactataaggtgaatacagtaatagtatctccctcaggaagctgttttgaacatcaaatgagataaggtattcaaagcttttactgtgctacttggtacacaataattgctcaataaatggtagcattcttttaaaggttctaattcaaataatgagtcccatttccccaaaaacatacgtatccatcaaaacacatgatacaacttgcagttgaaaatgtgataattatacctaaactctatgccaaaagggctagaaaataacaatagtattttcaagcatattcctatgtaaactgtaaaatcttttgccaagatagatttgtactgtggtagtcttataaaactttattaaatttatccaagttgtttaactaagattccctaaaaagtccccacacaggcatgtgaaataatacaactatctcctcccaacccctggagagtagtatgaaaccacagaagactatttggataagaaattaacctttcctgatacgcttctgagaatttgacgttgttgtgctgcaatataacatagcctaacctgactaataaagaactttttaatctttcccccaggcacccacttagaatggccttttcagcactcccctccccacaatgctctagacattttgcttagtgctttctccaccaaaacctacccacccatatcacatgtcatcagtgacaatgagttcatatattaattcttgctcacatactaatggcaacagaagtgtaaaaatgttatcccttctaggaacaaatgctcatgttttagctagagccaaacacaacaaaatgtccaaaatgttcacaacaaaaattctcccacaggagaatttttatcaccaaggaagtccaaatagaaagaaatttgggacaagcaagacattttctgacaataatatcgaaaaatgtctatgatgattttgtatacttcataaagtacttttacactcagtatctcaggggcaataattattattccactacaccattaaaggaatcgaggcttagaaagtttcatttggttgctcaaggtcacgtggctaataagaggcagattcagaactatttaatccagatcttctgacgccaagtacagaatccatcacccaagtatttataaatcatctaccatgtaccacacattttgtgggctttggagatacagaagtaaataaaacagaaaaaaaaatccttatcctcatgaagtttatattctagagagagaagaaaatggtagccaaacaataaataaacatgtaaatttattttgtgtcagttgggaagtatcattatgaagaaaaataaaatcaaagtatgggtgatagtgggtgctagagaatgccattttatataacgtagtcatggaaggtctttccaaaaaaaggtgcatttcagctgaaacctgaatgaaggaagaggaaaagccttttggctatttaaagtataaaccttccagataggggtggcagcaagggcaaaggctctgagacaggagtgtgtttgatgttgttgaggaacagtaaggaggccagtgtggttggagcaaggtggataaggggacaaattgtaggaggtgacagcgattagggagtaggggcagatcatggagaaacgagtgtgccaaggtaaagattttgggcgttatcatgaacagaatgagagccctttgggcatgaggaagactgggcagtctgagaggagctagcaatgtgtcaatcaatcagtcaacaaattaactaactaattattttggggaatccaactaagcatgctcatcgggcaaccttaaaatgaatatgttaagaaacaagaaaggctggggaaaaaacaatcatctatgctttcatctcaagaagtcaggaatagacaaataaattaagcatgtggtagatcacatgtatcggttagtaaataccaaatataataaatttatgatattgggtatcatccatgtaccaattctgtccaaattgatctactgatacaatgtaatcctaataaaatttcaacaggacttgtatgaaaattgacaggctgactctaaaattgatatggaaatgtgaaggaccaacgataatcaagacattctgaaacagaaaaaataagatagaatgactgcttctactcattaaaagatttattttaggccaggtgcggtggctcacccctgtaatcccagcactttgggaggctgaggcgggcggatcacctgaggtcaggagtttgaggccagtctggccaacatagtgaaaccccgtctctattaaaaatacaaaaattagcccagtgtggtggcacatgcctgtaatcccagctaatctggaggctgagggagaagaattgcttgagcccaggaggtggagtttgcagtgagccgagatcgtgccactgaactccagcttgggtgacagagtgagacttcatctcaaaaaaaaaaaaaaaaaaaagatttattttaagataacacagtattggcacaagagtagaccagtagatcaatgaagaagaagagataactcatgaatatatagatacttgtctaatgatgagtcactgcaaactagtggagaaaaaacaatcttttcaataagtggtactaagttaactgcatatccacataagaaaaatgaaacttgacctttacttcacatcatacataaaaatcaactctatgtgaattatatatctaaatgtgaaagacaaaccaataatgctttagaaaggaagcattatcctatggtaataggagaatatcttcataatattgcagtgtgaaaatagtttttattttttattattttgtattttttgagacaggttcttgctctgttgcccaggctggggtgcagtagtgccatcacggctcactgtagcttcaacctcttaggctcaagcagatcctcccacctcagcctcccgagtagctagcacgagccaccatgcctggataattttttaattttttgtagagatggggtctccctatgttgcccaggctggtctcaagctcctgggctcaagcagtcctcctgcctcagtctgcaaatgtgctgggatgtgagccagcccaggaaacagtttttaaataaaacaatactaacctgaaacaaaaggattaataaattagcctaaattaaatttaagaacttctggtcatcaaaacctaccatgaagagagtgaaacagcaagtccctgagtgggagaaaatatttgccacacatgtaactaataaagagctcatgccaaaattaagggcttctaccaatcaataaggtaagacaaccaatggacaaatcgattcaaaacttaacagataactgatagactgagaaggtgcctggcctcaaaaataatcagggatatacaaatttaaatgagaatgaaataacattacaacctcatcagaattgctgaaacgtaaaaactacttattcttttttttttttttttggcaaaggtgtaaagcaaaggaaaccctcatgtgcttacttgtaggaacatatgtgtttatacccactttggaaaccagtttgctatgtctaccaaagttgaacatacaaatgaccctatgagctggttgtttcatacatagagaggtatagcaaaaagaaatgcatagcctgtaaccccagcattttgggaggccaaggcagcagaatcatttgagcccaggagtttatgacaagcctgggcaataaagggatacctccgtctctataaaaaatttaaaaattaactgagtggggatgcacatacctgtagtcccagttactcagaaagctgaggtgggagggttacttgaacccaggagtttgaggctgcagtgagtcatgatcgtatcactgcattccagcctgggcaacagagtgagatcctgtctcaaaaaacaaaaagaaagaaaaggaaaaagaaatgcatacgtatatttgccaaaagaaatatacaaaaatgatgtgtcagtataatttgttataacaaaaaactcaaaataagcccaacgttcatcagcaggacaatatataaataacttatgatatataatcctacatgaacttaactgtttgaatatggaagtgacttggagtcacataaataaatcttgctgacctcaataaaatatatcctcaactcccctaccctcagagtctaaggcttggacaaaccccaaaaacatcaatagctatctcattaccactcaacaaaaggcaaaatgtgaaggcaggaaagtcagagtagaaagcaccaccaccttaagtgactatggtcaaaatattctccttatgtaaaatttacaaaaacacataaaaatgatgacaaatgaccatatgaacactttactgagcgctccaccccaccttagggctttggaagaggtctgtgtaaatgagggcccctatagcttaggctctattgtcttaatggtaaatccaactctggttagaagtgagatgatcacttttggaaggaagagaaggatacagattgggcagtggcacagaggggacatctgaagtgattggcaatgttccatttcttgaactaagcagtggatgcatgtgtgtttgttttgtgataatttattgagctgtacatttatactttgtgcatttttctacatgtgtgctatgtttaaaatttttttaaagcttaaaaggtaactataaaaggtgacagatatgctaatttatttgactgtagtaatcatttcactatatataaggatattaaaatattatgttgtatgcctaaagtatacacaaataaaaaattatttaataatttaaaaggtaaaatgtttaaaattactttcccaaaataaagtaattaaacttcctaaagtggctaattagcaaggcttgctattttacacatttaacatattggagagacagtttgcaaagattatttccttggaatcagataaaccaggttcaactcccaacttgcatcactgaataactctataaagttgcactgttcaatatgctaacaaccagccatagtggctattaggcacttgaaatgtaactattccagtttaagaggtgctaaataccatgctcctaaataaccaatgggtcaaagaaataatcaaaagagaaattaaaagtactttgagatagaagaaaataaagatatggcataccaaaacctaagaaatgtagctggatcaccgctcagaagacaatttagagctgtaatgcatatattagaaaaagaagaaagacctctaagcaataacctaaccgtaaaacattggaagaagaaaagcaaatgaaacttaaagtgagcataaggatggacattataaagattagagtggaaaatgataaaatagaggaaaaagaaaccattccaaaaattgatgaaatcaaaaactggttctttgtaatgatcaacaaaattggcgaacctttaattagactgctgagaaaaaagggagacaactcaaattactagaaccagaaacaaaagatggaacattactaccaaccttatagaaataaaaaggattaaaaaggattcaaaataattataatattcttatgaacaattatatgtcaataaattaaataacttagaccatcttagaccaacaatctcagtagacctctaacaaccaaagaaattgaatttgtgataaaaaaattacccacaaagaaaagctcaagaccaaatggcttcactgctgaattgtaccaaacgtttaaagaagtaatgtcaatttttcacaagctcttccaagaaaataaaagaggaggaaacacttcttaacttattctatgaaattagtattaccctgatatcaaaaccagacaaacacatctcaaaaaaaaaactgcagaccaaaattacttaagaatatggaggcacaaattctcaacaaagtactagcaaactaaatccagcaacatacaaagagactgcatttcatgactaagtgagactcatccctggaatgaaagattggttggtttaacatcaaaaaatcaattaatataatacaccatatcaatagaataaaaaacaaaagccacataatcttctcaatagatgctttaaaaagattttatgaaacccaaactcttctataatattaaaaagaataagaactcaaaaaacctaggaatggaagggaatttcctcaacctaataaagagaatctgtgaaaaaactcacagctaacatcatacttagtgatgaaaaactggatgttttctcctaagatcagaaatgagacaagaatatctattctcaccacttctatttaacattatactgaaagtattagccagtgcaattagacaacaaaaaaaaaggaatttaaaggtattcagattggggaaaagagaagtaaaattatctctattcaaacatgacataatattgaatataaaaaattctaagaccagcgagaaattatttgagtcaacaagtataatttatcagggtttccagagaaacagaaccaagagaatgtatatatattgcacacatatacacacacacacacagagatttattataagaaattcgctcatgtgattatggaagctgactagtcctaaaatctgaagcctacaagctgggggcccaggggagctaatggcttagttctagtcctagtccaaatgtctgagaaccaggaaagctaattttttatttacttacaaaagagttctgtggctttttttaaaataactttaagttctaaggtacatgaagacaatgtgcaggtttgttacatatgtatatgtgtgccacgttggtgtgctgcacccattaactcatcatttactttaggtatatctcctaatgctgtccctcccctctccccccaccccatgacaggccccagtgtgtgatgttccccatcctgtgtccaagtgttctcattgttcaattcccacctatgagtgacaacatgcagtgtttggttttctgtccttgtgatagtttgctcagaatgatggtttccagcttcatccatgtccttacaaaggacatgaactcatccttttttatggctgcatagtattccatggcatatatgtgccacattttcttaatccagtctatcattgatggacatttgggttggttccaagtctttgctattgtgaatagtgccacaataaacatacatgtgcatgtgtctttatagtagcatgatttataattctttgggtatatacccagtaatgggttggctgggacaaatagtatttctagttctagatccttgaggaatcgccacactgtcttccacaatggttgaactagtttacagtcccaccaacagtgtaaaagtgttcctatttctccacatcctctctagcacctgttgtttgctgactttttaatgatcgccattctaactggtgtgagatggcatctcattgtggttttgatttgcattcaggaaagctaatgttgtagttctagtttgaaagccagcagactcaagactcagaaagagctaatgtttcaattcaagttcaaaggcaagaaaaaacagatgttgcagctcagaggtagtcaggcagaagaaattcctttttatttgtgggcagggtcagcctttttttctattcagacttttaactgattaaatgaggctaagctacattacgaagggaaatctactttactcagtctatcaatttctatcaatttaaatgtcaaactaatccaaaacatcctcccagaagcacatagaataatgtttgactaaatatgtgggcacctcatgtcccagtgaagttgacacaaaaaattaaccatcacagcaagattgcatgaaacaagatcaatatacaaaaataattgtatttttatacaattgcaatgaccaatatgaaaattaataggaaaattcatctgcaatagcaccaaaaagtattaaatacttaggaataaattgaacaaaagaaatgaaagttatatgctgagaactgcaaaacattgttgagaaaataaagaaggtctaaataaatggagaaaaccctataatcacgggttttccaatccttaacattgttatactccccaaactgatgtgtaaattcaacacattccctatcagaatccaaactgacttctttgtacaaattaacaagttgatttagaaacttatatggaattaaaagagatctggaatagccataataatccttaaaaagaagaataaagtatgaggactcaaacttctctatttcaaaacttaactacaaaacaacaatagtcaagacagtatggtactggcataaggataggcatacagatcaatggaacagaacattgagagcacagaaataaacccatatgtctatggtcaactgattttggcaagggtaccaagacccttcagtgggggaaaatggtctttccaacaaatggtgctgggataacagaatagtcacatgaaaaagaatagggacgtctatagagatttaaattagattaggggtagtttatggctgaggatggggtcagggtggtaggtgagtgctagccaaaagataggagatttcatctcaaggggatgaaaactttctaaaattgcggtggctcacacctataatcccaacattttgggaggctgaggcaggaggatcacttgagcccaggaatttaagaccagcctgggcaacagagtgagaccctgtctctacaaaaaattaaaaagttaataccgagtgtggtggtagatgcctgcagtcccatctactcaagaggctgaggcaggaggattgcttgaagccaggaggtctaggcttcagtgagttatgattgcaatgctgcactccagcctggccaacagagcaagaccctgcctcaaataaataatatttatatatcaaataaataataaatataaaattgtgtaaaatttagtatattaacatatgtgtaaccatttgtgtgtaaccatgtgaatatattaaattttacacaattttaatttaaaattgttacacatatgtaaatatattaaaagccattgaattgtatactttaaatgggcaaactgtatagtatgtgaattatatctcaataaggctatttgtttaaaaaaaagaagaaactctaaattttaaagacaatgcaaaaaatacacaaggcatctcattaatttttacactgattacatattaagatgataatattttatatatattggtttacataaaatatataattaaaattaatgtcatgtttctttttattttttaatatggctactaaaaaaattcaaaattacatatatggctcattttatatttctattggataacgctgctctagagattttacacacatttgtaaaatgtgtgtaaaaaaacactctgaaccctaacttccttatatgttataaggctgtaataatagtactggcttcacacagttatggtgaggattaaatggttttaaagaacttagcatttggatgttagcttttattctaagtgttagttcttattatcagagaagcctctgggtaccattgagtacagcagtgatataaaaaaaccccagtagacaccttggatttattttactattataaaattatttttagaaatgaatcttagaaaccatcacatccagtaatcactaactgtcaccttgccaaactgttgtttaacaaccccctggttttcaaaacttgaatctgagtatctttattgtgggactgcgctctctactttgctgtaagcctgaccactccctgttcccttagcagagcctcacacctgagttacttccttggtattggaggtatttgcatttatacctgatcctacactagtccaagcccctcaccttcctgatgaagaaactggggcccgtggaagggacactgagctgctaaatgcagaattcagcctgcagaggaccaggccagtcctcacacaggcaatgcattatccagaagaccctgactagcagggactgcaacacaggctattcagcttgtatgctaacacgctatccttgggagtcttggtgggacttccagtgttctttagtttattgccactggagaactaaatcattattggcaatcatgatacctttaatggagaccagtggatcattctgatgcagagggagagaagatggtacttggaactcagaagttccaaatagcctggtttaacatacgcaaaaaatccagttctgtgtaaatctgccaattagccatctctgcagcactgatctcccttttatttccttcctcatacttgtttatcaaataatacttaccaaagctcaatcatctgattcccagggtaagcccagagagaagtgtgacctgggataattagtcccatttcattgttgaggaaactgggcctaaagaagacaggaatgggagagctaagccaggaccagaagagagtttggcaaagttcactgaatgcatattttgtttttgccatatgcaaataccacctgcattatttagttatctttctttttcttcttctttttttctgctctgtcacaccagtgcagtagtatgatcatagctcactgcagcctcaaacaccctgtctcaagtgatcgtcccactcctcccacctcggcctcctcagcagctgggactacaggtacgtaccgctatgcctggcttttatttttaagagacggggtctcactacgttgcccagactggtctcaaactcctggcctcaagtaatcctcctgcctttagtttttattttcctttaacaggcacttactgtttttatgtaagtcaactgatgttgaaaggaaattttacttcaatgccttcagtagaaaactagtatcacgtgccattaatagaaggttaataaatataatacaaaacaattctaattagaaaccgttgtctggagagcttctaaaaatcctaatgcccaagccagaccttagagctattaaactggaattcctctggggaggaagcaattaggcataagtaatttgttaaagctctccccaggaaatagcatcatgcagccaaggatgagatccactagaatagatgctgttgcctgctaatgcctctaaggctgaagagtgcttgccctccttaagaagagagatcaacaagtgatagagaggtattaaagagacaataggcctggcgcggtgcctcatgcctgtaatcccagcactttgggaggccgaggcgggaggatcacaaggtcaggagattgagaccatcctggctaacacggtgaaaccccatcgctactaaaaatacaaaaaattagctgggcgtggtggcgggcacctgtagtcccagctacttgggaggctgaggcaggagaatggtgtgaactcaggagccggagcttgcagtgagccgagatcgcaccactgcactccagcctgggcgacagagcaagactctgactcaaaaaaaaaaaaaaagagagacaatagcctaaaaccgacactttctccttagcatcagaagaactgaaaagtaactttgaaatgggaaaagttttcatttgtaatttgttactgttgaatcagttgctcctttgcagtctaaaaccagctcacatggcacttgccctttggaaaacactggatcagaagaccccaggtggtgtggtttctattcctgtgccctttcagctccagcagctagcttcccagccaaagactcccacaaggtcactggagaacccctactcacctctgtgtgttctccagcagggactccaaaatgcctgcatttacatcacactgtcagacacatccttctatttcaaaatgaatcttctcagtggctcacattaaaaaccttaaggcaaaaccgcatctccgtctcctttcatttcctctcaagaagccccttgttttcgtctaggaatatctggccctagagaaggcttaagtcagccctgcccttttggatcttaaaaagaggtatagctagggaagagggagaaacaggagactcagtgcagatccgcacatgactttgagagggtcttctgctgtgaagtttctctttcatccctcacctctgaacacacacaagactgtcctgatggacggatgcatttagaatgaaagctggacttttgggtgaggattccagatctccataacatcattttcttatctggcttggggcatcactgaaagaactgggtacctgcctctgtggactagggtttgaagagctgccccagaaggactacatggcctcaagagcaagcagtttggctcactaggcaggttgttgagcaaacctctgatctgcttacttcctacatttacaacctagaatgctgacacagtgcctaccaccagatgagcaggctactttactgtcttgtcagcagaatccttctgtcttgtttcccttagagcctaaggttctgctttgaggtctcctccctattctccatctcaaagttacacagtcccacctcctagccttagctcttgttgtgcccatagtccagaatgttcttctgccccatccctgtctgtccaaagcctacccaccctcaaagctgattgaaaatgtcaactcctccataaagcctaagatgattcccctggtcaaataataacagtaatggaattaacaaaaaataacagtaataataatagcctagcatttgctgagtactgctgtgggcaggcaatgggctaagatctcatactcataatctcaaccaaatcttatactagatgtatcttattatccctgccctgccatttttgatatcaacttacttgttctctctgtgcctcatttttctcagatatcaatggggattataatatgtcttccttgtaagattgttttaggtataaaataagctagtgtatataaagcatcagcatagtacctgacactatggttttggcttagtgagtatcattacttcttgtaacaacttaaaggtctgggtttgtactgataaggacaggaggaagggaaatactgggtagaagagggcagggtccatggcaaggactccaccctcaagcctggacccgcagccctagatgagaacttcacatccctgttttcccgctcgaatgttgccttttctaaaaccaccctggcatgccacacttccctccccaccctgtacccacaaaaactccaagttccactggcagaggagcagagcggtgcagcagagaaggagagaagggaagaagtgtctgaacatcaagagtagaagaggcagctggacatcggagactatggttggagaggaatttggccaggaatggctgaactccagaggaagagtatcttcccactccatcccctttctagctccccatcccactgagagccacctccaccactcaataaagtctccacattcaccatccttcaagtccctgtgacctgattcttcctggacataggacaagaacctgggtatcaagagggcagggtgtgaaaggctgtcaccccaaccctccactgagcgggtaaacacttagctgtctgtggacagcaaatgctaaaagagtattgtttgtaacacatgcccccttgggctccagaggtcatggacaacccctagacactgccacaggctggtacacagtttgttcctaatggcttccaaaggcaatcaccccagctcctgctcctgctctcctgtgtgctccccctcatgcaaggggtttgagtgcagtggccaagtaaacaagtcaccaatgttgcaagtcccatgaggaggtcaagggaacaatcccatctcagtattattctcatcttatagatgagaaaaccaagcaatagaggttgagtaaacagtccaagttcagtgacaagcaagaattttacttccctctggtcttcactgaactttgctcatcacaaagatgatgtaaggataatcttccagttgccatgggaactcatttcatcagcatctcagccatcctagatgatttgcatacatgactttatgcagaaagagaaagttaaactgacttgaagtcaactggctctactggctactgtcctttgagatactgtgatatttgcattgcatcatggttctagggtatcccaaagacaggtctgctcattaatcctcatactttctctcattcaccaagaatgtgatccagctagggaaacagacgagagcgaccaaggaacgtgctggtggagcaggtgttgaattccttctctgcatttctgctcttccactctttaattgccttctggcaggatgttcctgactgcagaggcaacacctaaagcttagccagcttaactgcaggtctgcacaataacaaacccttcagaatttcagcactcatttcttcatcaagggccccaaaattatggttgtgtatcacctactcatttcctcttggttcaacctcacatgctttcatactactgctgaccatctgtacatgttactcacccctttcctcctttcctctattcaaataagccaggctgggttcgcactccagaggtacccctattgatggttgggcaaataggatacagtttccagaaagagtgacaactttgcttcctggaatccctgcacaaaatgcagggtcacatatggccctgaggagggatttggtggcaaagagatatctaactttagtagtttgaaagtactatggctagctgtggttccaaactctctaccaggtcaccctggggtagcatagtaaattcacaggactgttgggaggtattttaaattttccaagggaaagacaggatcctccatatctgttgaacactgcacaaactcagggttgttcatggtttcaacattagattacgtcatattcctttcagtgatggcatcttttggggaagccatgtttttggcagttactgtgacaaaaagcaagtgccacaaggaaatcagtgtggaacaggaaatgaaggtggcagtgtccactctgattccaaagtttaaggagttgcacagtgcccagcaggccacacatcccatgagtaagtaattgtgatgatttcagaatacaaaaaaatattttttttgtttcaatgtatcattttttttcaaatggccaatacaaagtttttagcacataaagacttttaagcgatttgaccctaactagttaatcaatgaatctatttggtatttcttttggcctacagatgccatgaaaaaattactgaagcactaagcgttctgcgaccaaggaagatttggaaacttctggtctggtcaagtcagccatgtttcacagctcccaagaacttcattggtacctgatcctatgacaaagcatacctgggtcttggttttggttatcgtggttgtttcatctcagagacttttacatattttcagtgctaaatgtgcctactacatggggcctgtgcagccatgtgcctcggccagcacctgcctcagactccctgggcatctctccctttcctctgcgcttaagtcacaccaacctcctttccattcctccaacccgccaagccctctcccattgtaggggcttcttactgattctcatcctggttcacctgtaggtcccaacttaaatgccacctcatcagagagccctcccctgtgattctctgtctcaccacccattcatttccttcatagcattttgtcctctgcacatatctatttagctctatgaggacagagtccaggtctgatctgcttactacattcacagaatttagctgggtgcctgatatgtaattgtcactcaataaataaccgcaaggttaacaagtgtcagtttaaatcatacacacattttaactggggccctgtgcagcccaaagcatttcagaaggcttttctggcaaacagcccatcagatagacacgtgggacaattgcatcactagccacaggcagagacagtcaagggcggtgtttgcgatcaagaatcccagctctgccacctccttgctggcagacattgggcaagttactcattctgcctctaccagccatgtctttgcttggaaaagggttgttaaaaggactaactataaagctcttaagtaaaatctgtcaagaaacaagcactctaaataaaagtaagctgcttttattaggacaaggacagtgttcaaggactatcccatgaatgcccacacaccattctgagaggaagtttctgcctcagaaactgacaggtccaatgcttcttgcttgttttagaataaaaggctcaattcaaaaaatgatatatggacaattaattcttagccccattggtgtcccccacacaactcatgattaaaaccaaaaagaatctgttatggaactttgattatccagctggacaacagaaatggagaatgttaggcagtgactgtcaatttgtctagactcaaactgctctatggcaccaagcacatggtggaatgtgtgtgcctaatccttccagtcctttgcttgtccccttctaaccagctctcttcatgttctaggcttaaaagtaagcccagtgcaccatgatgttgttccggttgtacctggggagttccaggggccaagggctgctcacagtcacagagaggaaatgacacatggctcctcttcttgcagtgggaagaagcatgagtaccagccttcatctgtccacaccttagttactgttgctctctttcctgggtctccttcgcccagcctctcccctacctgatcctcatgtctggatgcctcattttcacaaccccctggaatcacatcactctcctccccaagcgctatctacacttcctatttcatgcatacccacatcttagaaaaccatttctcccactggcttcctatagatggcctagctaagggtaatgtcttttctgctaacctgatttgctgtcactttataaattttatataggatggtcttacaagacagatggtactgatggactcaaacacgtgatgtgtttcaatcccagattctccatctactagctacatttttcatggaaagttagctttacatctctaagcctcagtctcctcaccagtaaagtgggcagaataatttccacctcatagctttgttgtgagtacgagatgagaaaactcacatgaaacacacaccacagtaactggtccacaggaagcacacccaaaaagtctactactgtggttgctgaggtcaaccccccatttggtagatctcagcttagacatcatctattctggaaaaccttccctcaccgccaccccgaagatgtgtgtgcatctaaagcacccttgctgtgattgtcattgcaaggcgtgtcacactgccatgtcattgcctcttagcttttttttcttttgccccctagaatactgtgagcacattactggtgggggcagtgttccttctactggggcagagcacctagcacaaagtacgtgctcaggacatattctatcatattaaaaatagctatttaggccgggcacggtggctcacgcctgtaatcccagcactttgggaggccgaggcgggcggatcataaggtcaggagatcgagaccatcctggctaacatggtgaaaccccgtctctattaaaaatacaaaaaaattagccgggcgtgatggcgggcacctgtagtcccagctacttgggaggctgaggcaggagaatggtgtgaacccgggaggcggagcttgcagtgagccaagatcgagccactgcactccagcctgggctacacagagagactccgtctcaaaaaaaaaaaatctacttaaacaagcaatctaataaagatgaaattttgctgtgttatacacttattattgctacattggaagactagactcccttggcaaccaaacacattcttttttatattatttaattttaataagagttaccatatattgatccatcttctatgccaaatgtaacttaatccttctatcagttctctgaggtagatattatcagtagtcccatcttataaggaaaatgaggctcagagaattgaggtactttgcccaagatcattcagctagtagaacagagctgggacccaaacccaagaccattcatctccagtgtctgtttgctttgctgcctccaataagactgaggatgccactttcctttttgttaaattttctggcctcccaaataccgtagagtggcatttcattattattggcacctacataacaaacatggtaatgcctttgatgtaaattcctttggtgactaatcaaccccaccttgccatatttttgtctttggcactatttaactttcatgcttcgtcaagtctccttaactggagtgtaactggctggtgacagtgccaaggtcttaagattctttctgtctccccaggtctaaaaggaacatctctcacctactaaaacacataaatgaaattgggtttctgtctatttggctgttccatgttcaagtaaaatgactagaagatcatcaccaagtctgaagggtatttgggacagcttgatttggatctgtggtatacacagctttcacactgggggaccagggaggcacctcaagaagatagacacacttagtaacctttgtactatttgactttttttttttttttttttttttttttgagacagagtctctctctgtgacccaggctggagtgcaatggtccaatcacagctcactgtaacctcagccatctgggctcaagtgatactcctgcctcagcctcctaagcagctgggaccacaggcatgtgccaccacacctggctaattttttaaatttttttgtagaggtggactttcgccatgttgcccaggctgatctcaaactcctggcctcaaacaatcctccctcctcagcctcccaaagctctgggattacaggtgtgagccaccatgcccagcatagtttattttaaactagaggcatgagttacttttttaaagtaccatcaagaataaagatagatagatagatagatagatagatagatagatagatagatagatagacagatagacagataaattttcaaagccaaaaattagagagaaaatgacagggcagaagaccaggggtcatagttattttccagagcagatttccagaacaagatacaataaaagcctgatgaatattaatataaattttctgtgaatggagaaacaaatgcgccttaaatgtgagtcccaaatcaactgtcacaaaggaagatgctccaaattgcaggccccgatttttggtcaatctatttctctccaggagaattctatgtgctctagggtgagtagcagcagtaatgtactttattggatggtgctttaacaattcatcctataaatgcaggggatgctggttaatattcaataattgttggttggaggtgatgttgataggggaccctcagacaatagatgccaggacttcaccacaaacatctgcccactccatgttgttcccaccttgtcttgttctatctgtctctactaacagcaagaccagaccaactgttctcatacctttctagcataagcatttctacatctcagcaatcctacaacctaggacacacccacttccttccagttgcccacacacccatttctttcactgggattaccaaagagttgaatttagaaaggaaaaaaaaaaaaaaggtttccatatgcaaatggcaaaatcaaggtcaaggtggaacacttgctctgcagtcagtccagttgagcaggccaaaaatgcccactgggataatgaaattcagtagtgactgcatctaccaccctctgcccttatcatgggccaagggtggaaggacgatattgaaaacatgtgatcacagtcatctttgaaggggaagaaattaatgaggacattgtaggccctttgaaagtgaagctgattctaaccacccagcgggttctccttgaaccactgctcagacagagctgaattatccagacaggggagttgcaacagagaaaaagtttaattcatgcagagctggctgtacaggaggctggagttttattatcactcaaatcagtctcactgaaggctcagaggttagtggtttttcaaagatagcttggtgagtagggagccagggagtaaggaatgctggttggttgggttggagatgaaatcatagggagtggaaactgtcttcttgtgttgagtcagttcctgggtggggcccatccggttgtcagaaatgcaaaaacctgaaaagacatctccaaaggccagtcttagattctaaaatagtgatgttatctgctggagtaattggggaagttgcaaatctttattcctcctaagtaatggctggctaggcatacttcctaacagaattcaggcccctctcatcctcctaacttggtggcctttcattagttttacaagggcaatttagtatctgggaagggccattataatttaactaaatttctcccaaagttagcttggcccacacccaggaatgagcaaagatacccagaagcaagatggggacagttagggcagatccctttcactgtcataattttctcactgttataatttttgcaaaggcaatttccactctaggaatcttttgcaaagcattaaaacaaaacaaaacatgcattagaaaggccactgaaaaactgaatgagctaactcaagcagttttctgcctccaggaaataccacacctaaaacagatgcttcctcatcaccatccataaaagtacaacatttcagcagtgacctggtgaaatgcatccatcccaggagaaggttctcagctatgagcacatgtaattatatttgaaatatggactatggtctaactaggtctgtcagattataaaacacacattcttgatgcactatatattctgccttttgtgtgtgcttcacttatctcttcttcggtaacttttttctttttttctgattagaaaagtaatacaaggtcattgtagacattctggaaaatttaagagatcattaaaaagaaaacaaaaataattcgccctcataccactcatatatacactgttaaattttgtgctctagaaccttctgttaccactagggaatgtatctaagtcacgtggcaccaaaatcacgtggcaccaaagtatgttagtggtggtgaactaacctcagttcttgcctcctcatgaaacatgaggttttccttgaccccttcagagtcctcctgacaggaatgcctcacttactcagtccacagctctcaacccctcatgggcgggggggcagcacacaggtgagcaggtgcaagagccagagcaaatgcttttgggcaccggcaggaccaaaactctgtgcaggccccacagcagcatctagggtggagtacccatgacccctgcagccccacaggacatatgttacagtgcacttttttagctttgctatccatggttggattaagtgtttaacaactcagtgaaccctctgcctttttgcaagggcagagggtcagtgtgacagcctttagcatcctcacccatggcacctgagatctcgtttggtgtccaggaaaaatcaggttgcatgaacgaattgaagggcggtgaatgtggaggattttattgccagtggaagtggctctccacaggaaggggaggtggaaaggggagggaccgggaaggtattcttcccctgaagtcctgctgtcaagtcatccctctgaagtcaaactgcttctctccagcattcagctgcttcttctctcctccccttctctgctctctgccagtggagcctggggtttttatgggtgcagaatgtgggggcagggtgggccatgggtggtttgggaaacggcaacattggagtgggaaaacaggactacatgttctcactttgggccacagcaccaggcttgagggtgggtctttgccaaaaacccccactcttttctgcctagaatttctctgtctcctgtccctattactcagaagaaagaatttgaccaaagggcttaagacagagtgagagacccaggcaagttttagagcaggagggaaagtttatttaaaaagttttagagcaggaggccagacacagtggctcatgcctgtaatcccagcactttgggaggccgaggcgggtgaatcacttgaggtcaggagttcgagaacatcctggccaacctggtgagaccccatctctactaaaaatacaaaaattagccgggcgtggtagctgtaatctcagctactcaggaggctgaggcacgagaatggcttgaacccaggaggtggaggttgcagtgagccgagattgcgccactgcactccagcctgggagacagagcacgattccatctcaaaaaaaaagttaaaaaaaaagagaaagttttagagcaggaacaaaaggaagtacacttggaagagggagggtgacttgagagattcaagtgtatggtttaacctttgatttggggttgcatatgctggcatgcttctggggggttgcctcccttctcccctgattcttctcttggggtggcctgccagcacttgggaggggccacatacacagtatgtttactgaaattgtacgcatgttcacttgaggcattcttcccttactagttgagtgttcttagaagaagctcatacaccagttaaattcgaccattttccctcctagtgctcatgcttaagcccattcgcccagctcctaagatcttatccggaagctgctaatcaccagcttcaggtgttctatctattgggagactgcctttccctggtaccagctgtgaccaattattattttagagaaacagtttaataaccatctgaccctcacctgatggttgcctgacattcctagtggtggtgggcggggagtggcgggggaaccctcttctgccctgctcatgtctgactagctatctgccgtgacacttccactcttcttttggtaagagcatgtatgtatgaggcaggaggtagaagctacttcccatactcctaggctagaagtatcccttcaaaagcaactgaccatttgggggaagaagccttagttttcattatccacacaattgccctatttctgcacttcactggccgcacaaatcacttggactcatgtaacagacacatgtgactgtatccataataggttcattgcccattgcacacagcaagtcaatacgccgagaggccaggttgcagcagagaaagaggtttaatcgtagggtcaccaaatgaggagacaggaagaaaccttaaatctatctccttgtggcatttggggctagggtttttaagagtttgggagtgggctgatgtgttggagatggttgactggttgaagagtgcatggtgaagtcatgggacagggtgaagctgtattttcaacctgatcccctttctttgtgggggttttcaaactgaaatatggtagaattggggacctgaaaaacaacttaagtgattcttaaacaaaagcgttctgattgtaatgtcagagatcccatctaaaggaacaatagggatacaaatcaattcctacacaatcttatgaccctaatgtcagaaatcctatctacaggaataatgcagatgcaaatggtcaggatctagtgctacatgactttgagcaacaaggaagtgggccaacgtgcaacctaatcaatgcttaattataactatattcctgtccagaacccagcatgcaattcttgtcaaccctgtgagggtggtttcatgactctcaatggcctaccactttccatctagtagggcaaacctgccttgtctatcactttccttgtaataagcccattctccttgtcagggagtggtatacaggtgataagtgagacttcatgaaaaggctatggagcttgtagggcaaattatttgctcctaagagacatcaacaggacaagatagtcttttcttatcccaggtgttatcagtccttagtggattgatgcctggaactgcagagctccttagaaaactaagcccagggcaacctaattgatgcagacgtgaaatctgttcaagtgacctctagcaagtcactgcaagtgactgaatacaaaatagactgttgcaagaaaagagcaacttgcagaacaatatgtatagtatgattccatttatatagccagatagatataaatacatagagaagcattcagaagctctgcaggaatgctggcactggtaacctctggaagccacaggaatcagggcctcaacattgtattctatgtatatttgtattgtttgaagtttttacaatagcatgcatgcatgtattgcttatgtaattttctaagattttaatttttataagtacacatggcttctcctttatttgaaatgtgtactagatgatcaaagcattcttctaggagaaaataagtttttgtggccaaaaaaattctttaagttatttttggtttttagggggttgcctccatgtcacagcttaatcatcagacacattaaccttgcagctcagcacgccctctgtttgtcagcagaccttcctcgcccatagggtaagcaatagaaagcttataggtatcagtttattttgcctgggatcagggtctggattgtgaagtgggacatgttgataaacctcttctccaaaattaggtcaatgggcatttggctcatattaccagaatgctggctggccatgtacagcctgtctccgagagaggctctaatgtggcccccacattagaacaacctgccaatgaccacattagaacctccattgttaaaatgcaggttcctgagccccatcccagatctgaatcacaatctccaagcatcagccccaagaacctgaattttgttgttacatgcagataaagtacgagaaccacttcctccatgggtgaactgaacttaccaaaatagtcagtcccgaggggcagagatggcgtaggtgccagttcttctttctcatcctagatgctcagagtcaaattcttggctcagcaatagacaagtgatttcactgtgggaagacaattcagagccctgttccaggctcctcacattgattctctctgtcttcttccactcctctttgtcatctttgatgtccccttgtgagctacgaaaagactttctgggacacgacaggataaaaaaataaataagtgcaagcagccattcattaaacgtttagccaggatgctgctttaactgcatcccatcatatctcattaatcttcacaccagtcctgagatcaggtactattattaacccgattttacagatgtgaggaactgaggcttaacgaaggtaagtaacttgcaggtgcgggtatccagctctctaactccagagcccatgctcttaaaaccctattacttgtccctggtggaggtgaacactgggggccctttcatataggactagccctcgggctgcaatctgagcggaaaagggaggatgagggcatacttcgaagcttcttttgcataactggcgctggatttttactgagactttacgttacagttttttttttttaattttcaaggtgcttttacgaacacatgaataaaatatttgtgtcattttgaaccttacttgtcttattttatgcatgtatttatttatgggggggcacaaggactcatctgtggtggtgcagccactgtaaataaattagtgaaactacttcacgtcaatttctgttcagtacactttagtgatggatcggaggaaattaatacatgtttacaaaaagcccctcccccagttgttacatatgcctcagagataccagttgtgaaaagtgcaggtgcacttacacacatacgcacacacaccccacaaatggtatcatacgaaaaaacatacctgcaatctgctttgtccacttaattgtatatcttggatacagaacttgtttcactggaaggctaaaaggcaaagtctggggaggcctagaggacacaggggatgggaggaggcgctctgagctggatgtaaggtctccacccacggccagagcacaaggtcggataaccagtgggcctgccggcttggctgcctgggccctcccctgccgagacaaacggctggagggaggaagtgtgcggctgggaagctccgctgctctggcccgggtttcccatttcccccttcccgcgctgagacggcgaggaaagttagcccggaaatctgcgcccgcctaaaacccggcctggtcccagccaccgccccaggaacttcccccaccgcaggggcggaggtcgagagcagggatggagaagtggacctgcgcgggtggactccggggcgcgggtggactccggggcgcggggggactccgaggagcgggtggactgtggggcgcgggtaccgtctcgcagcgacctctgtcggcggctctggggatggcccgcatctgtctgcgtgtacctggtatacgtgcaggtacatgttcctgttcacgtgcagactgggcgggggatgggggggtccacaccggtgtacacctttgcatacctcttagcaacttgaaattccaccacgagagatatctttattccgctattcctgtgcatctgcacggagcccctagggccatagatttgtgtgcaaatgaaatgaggatgtagtctgggtgcccaagggggggtgccttgagtgtggttgtctgtatgcctccctgagggtatttcactttctgctcccatccgcccctatgagcgagtacctatgagcacaggatgtgcacatatttgagtcttattagtggtacacgcagttttatcatctccccaggtctgtgtctgtatgaaatgtgcatgggtgtgtgtgtgcacgcgtgtgttcccactcggggaatgtggggagaggtgcatggagccaagatgggtggtaaatagtatgtttctgaaattaaaggactaatgtggaggaaggcgccccagatgtactaaaccctttgcccttcatctcatcctctctgacttgggaagaaccaggattttgtttttaagcccttgggcatacagttgttccatcccgacatgaactcagcctcccgtctgaccgccccttggccttccttcttcctcgatctgtggaacccagggaatctgcctagtgctgtctccaagcaccttggccatgatgtaaacccagagaaattagcatctccatctccttccttattccccacccaaaagtcatttcctcttagttcattacctgggattttgatgtctatgttccctcctcgttattgatacacacacagagagagacaaacaaaaaaggaacttcttgaaattcccccagaaggttttgagagttgttttcaatgttgcaacaagtcagtttctagtttaagtttccatcagaaaggagtagagtatataagttccagtaccagcaacagcagcagaagaaacaacatctgtttcagggccattggactctccgtcctgcccagagcaaggtaagcacttcccaagcccctacctccctcccctccctgtgggcctgcagctgtccaggtgtagaaaccgttagtgtgctaccccagcagctggcaggagggagttggtggattcctggaagcatccctggtgagtcatctgctggaacattagtgaaaacttagtactctagggaccgatgtacagtgtccattttaaaagccacctaataataactgtatagcaagatctgtgtgtatgcatagtttgtggaaatgtttgttttatcttattttgaagtggtgtgtattgatgtataaaagtatattcctaaatgttaatgcccatcagttaaaggattgtatagagctaaagtgagtggtgcctgccttactattgaaatttttaaaaagcctttcgtgcattccttaaagtaattggattcataattataataat

SEQ ID NO: 21 - DNA, 40001 bp, Homo sapiens
aaattaaacttgcccgggaccacaaacctaaaaagtggcaaatgaagaaattttaaagtatagcagtaaaagtaacactttgggaattaacgggaggttaactttcaacaatcccagcaaaagataaccgtgaagcactaagaactccggcgagaaccgcacaccagcaacaactgcgaggtggtgcagggtcgggggctgtgctaactgacttaggggagcattaggaggcaggtggaggctccagaaccaaaaaggccgggatgccttcaacaaggaggttgaggggagggatggacaagcctgagaagacggaggaatgaagtttggggacgcaaaacccactgggaaacagaaagccctccaaataggctagactgctggatgggaggacagcggcccccgcgactaagcgggccggggctaggggcctgggcgtcagactaggacagacactatccccagcccgccgcagtgcaagccacgccgcgcgggccgcaaagccactgtccccgagccccaacagcgtctccaagggcagcgcgccagggtgccccgcaacccctcacctggagcgcggtggaacctgcggcagcggacgcagaaaccggccgctgagagaccgaaagcgaccggaagtgaagggcgggaccggaaccggctgaaaaaccggaagtgggtggtttgaaacggaaatatgttggggacggaacaactgcttcctttgaatctcttcgggtgctaatcaaatggccgctgtaagggatctccacaaagccacgaagaagccaggcctttccgagactgtaaccgctgtgcagatagcgccgatccctgggtggccgctctctcgttctgcgcgtgcgctcgttctgggctgggagcggatgggtgctgaggcgtgtgacgtctctagtagtgtcgtaactgggtgtgctgccttttccaggtgtactgaggtcttcgtgagattcagggctaggactcgtgtggctgtgtcatgttccgaatgaagcttaaaaggtgatctttgagaactgaagacttgagacccctccatgggcccaggggctgccaacactaataatttcagagacttagaatctgaggagaatctccaatctaaggggaaacggaagagggtcaggaaagagaaggggcaagcttaagtgactcagaatccaagaagcaagtctcataggagagctgcgatcgaggttaccatacagtatccaatcgtctcaaccttcccatccatacttccatgctgtctttcctctgaatgcaaggaaaaccggttacacaaacgctgacaaaagaatgtcagacttgaatggaaattcggagcagtacccatctggtccatacagcgaactcccagtgagcaccacggcaatgtaactaattcatgtttccctcttggcagtgcgggaaaggcagcaaagagccaagttttgtatcttaacagttctttagttaagaggcacacgctattttgcattcttccctacttttgataatttttggctgcactagtaatgcatgagtatctgctcatttaaaaaactcaaactttttcagtgaaaagtatgcccttttcttcagaaagtcttaattaaaaaaaaaaaaaaaatcattgcccagaccaacattttcaagcattttctcaaatcgttttcttggaatagctgcatagttttgggtcttacattgaagtttggtgctcatatgtgggagctaaaaaaaagttgactccatggagatagagagtaaaattgtggttaccagaggctgggaaggataaggagggagaaggagatgaagagaagttaaaaggagcgaaaatatggttagacagaaggaataagttgtagcgttccacagcacagtagggtgactatagtaatcaataatttattttgtatttcaaaatagaggagaaaggttgggatagtctcaacacaaatgataaatgttggccgggcacagtgtggctcacacctgtaatcccagcactttgggaggccaagacaggcagatgactagaggtcaggagttcaagaccagcctggccaacatggtgaaacccagtctttactaaaaataaaaaaaattagctaggtgtggtggcatgtgcctttaaccctagctactcgggaggctgaggcatgagaatcacttgagcctgggaggtggaggttgtagtgagccaagatcatgccactgcactccatcctgggtgatagagcaagactatctcaaaaaaaaaaaaaaaaaaaaagaaaagaagaacttttgcctcctgttgctccctggagcctctcttctaatgtgtggaggataatatacttgtccttcattcatgcatctctgtagcagctaaagatgcctgggaattcctccatagattgtcaggtctgagagtctaaataatatatggaaacaatttcacaacatcagatgacaaactgttaatattactgtgaccacatttactttggaagataaaaggacattcctgcacctaggccagaaatcccccactactctgcttttatctccatctcccccagacttttttctccccttttctctctctggccattttctttctctagcaagtgtgttctcttgcccagctcagatctactcccctcaaaaagctttccctctcttcccagttggaagacaatcctcttcaaaaatttagttccctctagaagtttgtctctctcttctaatacctactcctttgcctttatcttgcctgcagtaagagagctgaaaatatttagaatctgccccacatgacagaatacaggttcttaatgaagcatgcccagttactgcccttctctattcagcatgctttccccaaactactacttaaaaactccattctcttcaaacctcagaacttccaatatactcctttgctctaggcagatgacattgtcccatattttggcaattcttcaaacctctgaatctacaaactaaggtatattttcagtcatcctcactcttgcttatttcagttgaggcagttcgcttctatttgaagccaaccctttaacttgttctccggcttcttccttctaaggaagctttctataaatccaggattcccttctcttgctcttgtatttttaacctctttctactggctcattcccatcaataataaacatgccatggtatcttgccatcatagccatcaccctttcctttcacagatggatattcagaacattgtttacagttgtctgaacttgacataatctataattgtatacttcttggaaatattctttctttagtgacattctctcccactatattgtaagcatattagttttcacactgctataaagatgctacctgagactgggtaatttctaaataaaagaggtttaattgactcacagttccacagggctagggaggcctcaggaaacttacaatcatggaagaaggtgaagaggaagcaaggcatgtcttacatggcagcaggagagagagagagcgtgcacgcaggggaacctgccccttttaaaccatcagatctcgtgagagctcctcattatcatgagaacagcatggaggaaaccacccccatgatccaatcacctcccagcaagcccctccctcaacacgtggggattataatttgagatgagatttgggtggggacacaaagacaaaccatatcagtaaattttgttaaggaacagacaatttattcacctttccattctcagaacctagcatgatattggctaacatagatgctcaataaatatatgctgaatgaatgaataatgaatgttaagtaataagagcttatgatgtaacagttgtcctttggtattggtaggggattggttctagggcccccaataaataacaaaatctaaggctgctccagtccctgatataaaatagcatagtatttgcatataacctatacacatcctgtcatacactttaaatcatctctcaattacttataatatctaatacaatggaaatcctatgtaaatagttggtatactgtattgcttttacttccattattttttattgttgtcttattatctttgggtttttcccctaatacttcaaacccgaggttggttgaatccgtagttttggaacctgtggatccagagggccagctgtacatattacgcttgtaacaatacatatcaatgaatgattacaatttgtatataactctggaggtacaggaaaggtctgaaatgcacactaaaatcgtgatagatcatagctctataggatgtattcagtaaatatttgttaggtgaattaatgaaattatctgtggcatcacagaacaggcaatttccatcttgtttatatttttatgtacatctgaattttttacagttttacattacttttatttcttttttatatgagaagttcataaaggcattcttttaaaaaatattgaaataacacagatacgttcataactctgctaactttttgtagtgcctatcattgcttttctagactttatacacacacatacacacatatgtatagtttatgttattttttttttatcttgctccgttactcaggctggagtgcaactgcaccatcatggctcactgcagccttgacgtgctgggctcaggtgatccacatcagcatttcgagtagcttaaactacaggtacgcgccaacatatccagctaattttgtgtgtgtgtgtgttttctagggcagagttttgccatgttgcccacgctggtctcgaactcttgaactcaaacaattcacccatcttggcctctcaaagtgctgggaattacaggtgtaagccaccatgccttttatgagacttttatgagactttttaaactctatttttagataattgtagattctcctgggaatctacaattatctaaacctacaattatttaaaatctacaattatttaaaaataccattatttaaaaataattataaatattttataattataatgatacttatatttataattataaatacattactttataattataatttttaattattataaacttctgcaaaaagtcatttgtacccttcactcagttttccccagtgaattacatcttatataactatagtacatcaaaaccaggaaattgacattgatgcaatgagtgtacatatagctctatgccattttatcacatgcggattcatgtaattaccactatgatcaacacaaagaactattccatcaccacaaacatagcacttgtgttacctctttgtactcacatccatccacattcctcggaccactcctaatcactggccactaatctgttttccacctctataattgtgtcatttccagaatgttatgtaaatggaatcatacagtataagtgttttgaaatcagcctcttcattcatcataaggcccttgggatccagtcaagctattttgtgtatcaatagttcatttctttttatggctgagtaggattccctgtgtggatgtacaacaatttgtctagccattcacttactgggcattttagttgtttctgagttttgccttttagaaataaagtagactgtttgtttataaggtaattcgtaatctgttgagacttaagtcttccaacccatattttgttttctgtttgttgcttctatttttagtttttctatttttttcttgtttttctattgatttcttgaatattattttagaattctattttgatttgtctgcaaggtttttgagtgtatctctttgtataattttttttagtttatctctgtaaattttgtagtggttgctctaggtattacattatatttacataacttaaaacagtcaattagcgataacatgttagtagttcaagtgaagcgtaaggggatttattagagggattggctcacacaattgtggaggctgagaaatctcttgacaggtcgtctgcaaactggaggctctgggatgctggtagtgtggcggggtctaagctccaaggctgcagaaccagggaagtcagtgatgtaactccgagtccaaggacaaaggtctgagaacccagttggttggggagggagggtgacttttgtgtaagtcctagagttcaaaggctggggagcctggagttgttttcctaggacaagaaaggaaaaagtgcatcccagttctggcagatagagtgacacattcaccttttctctgtttttgttctttctgaacccctagcagattggatggtgcctgcccacattgcgggtggatctcccccagctagtccactcagacccacacactaatctttgctggaagcatcttcacagacacacccaaaaataatgctttaccaggtttctaggtattccttaatcaagtcagattgacatctaaaattaaccatcacagtaggtctgctagcaacaaaagctcttagtcttccttcatttgagaatgtcttgatttccgctttattcctgacgcatattttcactgcatacagaattctgggctggctgttcttttcttttggcacttgaaaaatgtgcttctttcttctagcctccaatgtcttagatgagaaatcctgtgactttctaattgttttctactctactcataagccattgtttcccttttgctgctttcaatatttttatcttttgtctttagttttcaaaagtttgactaatgatgtgtcatgatggggatttatttgtgtttatcttgtttggggttcactcagcttctttaacctgtaagcttatgtctttagccaaatttgggcaattttcaaacatgaattctttaaacactttttgaggtctaccctctttctcctctccttccagggctctgacagtgcaaatgttagatattttggtatagtctacaggtccctgaacctcagttcattttttttcagtccatttttttctccattgttcagattagataacttctcttgttctatcttcaggctcattctttcttctgtcccctccattcttccatccattgattttttttgggatattgtatttttcagttctaaaatctccatctatttttctttataccttctattcctttgctaacactttttattcattttgagcatgttcttagttgttcattgaagcatttttatgatgactgctttaaaacccttcatgtaggctaggataacgtcattccaacatctgtattatcttggtgctgaatcttatttaaattttctgtttcagcaggcttcctctgacactgaattgttaggagaagggagatgccacctccaacctctctgactagggagagagtcaaagctctccatcaggcctcccttgacaacctaggttggtggggaaggtatctcattactgctgagcagggttgggagttcaggctccccactaggcctccactgataccaccctggttgggagggagagggatgcctcattactgccccatgtaactgaacctaggttcagctgctcactgcttgaaagccagacatgaaaaatgatggttggtggaaggaaaagcagatttattcagatagccagctaactgagaagatggtggaccatcattctaaagtaccatcttaagtcaagacaaattttaggctctttttgtgtaagggtaaggggacaaggagggagttgagatcaagagatgaccaataaccacagacatctgggcaccagtgagggtccacagtggttgggaacttctttgtcatgtgaaaatgttcctataaatctttaacaaaatatagttagctgtttacatacttctcctttaatcctagagttcatttttaaaactacatgattgctgtttttgcatattatctcagtgttctaaaattatcctagcctacatgcaggaatgagtaaaggccccttaaaaaatggattagttatgttagttcttttgctgtttcactgtcatatcctcacgtggcctccaatgacactttggagggtgtgtgggggactcattaccactggaagatggtgaaagttgggcttcccactcagccttctctgaaaccagcctggtgggggtttagaggaccctatagtccatcaagggtgaaagtctaggcttcccagtcagctactactgatcggtgggggtgggaacactcctttttctgtgatatttggttggagtatggcagtgtgtcagaggtctccaagaacactcccaggttcagcgtttcattaggaggactcacaggactcagcgtatagttcctgtcacaaataaaatgagcaaaaggaatagcctcgtggaatgaagtctggaggaaaccaggcccaagattctaaggattctctccaagggaaattatacagagcacacttaattttgttaacagggaactgtgacaacaggcatgaattgtgtctacaaaggaagattattagagaatcagtgccctaggttttggggacagttgattattgtattagtccctttcactgctgctataaagaactgcccaagactgggtagtttataaaggaaagaggtgtaattgactcacagttccacatgtctgggttggcctcaggaaacttacaatcatggcagaaggtaaaggggaagcaaagactttcttcacatggcagcaggagagtatgtgcaagcaggggaaattcagacacttagaaaatcatcagatctcatgagaactcactcacaatcatgagagcagcatgggggaaaccactccgatgatccaatcacctcctaccaggaccctcccttgacatgtgggaattatgggaattacaattcaagataagatttggatggggacacagacaaactatgtcatcatgtagatacccactgtcttgcacctatcaaaactgcagactctcagaaggaaagcagctgtgcagcagaagctacattgtttgccaacagtctagtctcagtgagccattcttatcatttggggaaagtttcatatctgtataggaactgtaggatgttcccagatgccagccaaagaccaatcttgcaagcaagaatttctaaggatggcaggcttaggcctcccatggtaacttttctgcatatgtggttattaactaaatgttttctgccttaccaggctgttcctttcctggtcctttgtctagagacagcaggcttggggtagggatgggggagtgttacatgaaccccctggcatttctaggttgcctgtattgccagtacgtagtctgggatatatgaaacaaaaagaaatcccaaggaatttgctagcatgttttttaaggtaaatagccaatctgccttatttctaccttccagagtccccttatatttattttacatatactgtccaggatttttagctatacttagcagaagaatagggagacgtgcaactggaactgtcttggaactggaaatctctgtattacttttacaatgagaaaaaaaggcatttttttgttttcgttttgaaaacaaaacatatctatatatgacacagcaaacaaaacaaaacaaaataaatgaataaatatgatatagcaagcttaacctaaatatagggctgaaaagttaccaacaggagtgaaaaacattatcatgacttgattccacttattctaacagtaaaatgcattttctctcatttataaaaataacatgtactcggctgggcgctgtggctgacgcctgtaatcccagcagtttgggagtctgagttgggtggatcacctgaggtcaggaatttgaaaccagcctggccaacatggtgaaccccatctctacaaaaaatacaaaaaattagctgggcgtggtggcaggcacctgtaatcccagctactcaggaggctgaggcaggagaatagcttgaacccaggagggagaggttgcagtgagccaagattgtgccattgcactacagcctgggcaacaagagcgaaactccgtctcaaaaatacaaaataataataataataatatgtactcattataaaaaactgattctacttttctttgacacaggtggttaatatattagttttctttatttagtaaacaaaatgaaaacttcaaagttagtaaagattgcagggtggcagaatatctacattcatttaatttcattatcatttatagagaagaatatagagtagaaattttcccacagtcaaagggtggaacagaccttccatagatgtcccatgcacagttttaataggaacaataaaatgtgtgcttctcttttatatccaaagtcttgtgcattagagatagtatcttcttacttatggaataataattacaatgtcccaacccacaaattctaggctaatgaaactatttctgagatgaaaattttagcataatatattgctgcctaatcacattcactatgaaatcttaaaaaagaacatcaaattgttatgttgtagtatttaacattatgaagtaatttcatttatttgtttttttacatccacagtgactcataagtgaataaattaatatctcccatgcttcaaaaaatatcaatgaaatgtttagacagttacaatctaaacatttacaacacaacaaggcaagctttgattaccaataagctatctgtaatgactaggctaccttgttttattcattatgcttccaatcttcaggagacatttctttaacaatgtgtttatttccaaagagcattagacagggttctagaagcagccttgcctaaaattgccctcctgaccttgaggcaatcaatttcccctgacctcaattccatttgtaaaaatgagtttattgaatagccaaaagacaaaaagataaatacgttctgtgtttcagagcctctatggtttaatagttctcagacaacagcctatgggcctgggctagattttgacagtttccatcaatcttccgtttgcaaaatgagaaacataagcatcacgtaatccgtaaaaccaaatggaaaattcatgttcttcctctttattgacagctattattacttccctgatatctgcatatatctctcctggaattttcagagcttcatcattcatacttaaataaattttatagaaaatttacatttagtatgtagaattttattgaaaacatcaaagtagtaatttttttcttgctactgtataaatattacctcaagtgacttgttttgaaatattatttatggttttaaataacagaaacttaaacatgctagcttgagcctaaagggagttggggagaggaagcaggagagcagtattagaaagagcacagtaccagacacagttatgcctgtcgttgaaccaggagtcaaggtgagtccaagatcctcaacaataaattctagatccatagaccttctctcaagaacactgccattcatatgactctgactcctagtttctgtattgctcagctccaaattccaaaatcctgagatagaatcttattggcctcacttaggccacatgtccttctctgaaccaatcagttctgcctaagggatcaggttctgcctgagcttgtccctgtgtactggggagggttctcagggatgagaccctctctgtaggcctattagccactcctgaagttattctacactgacagttaacagtgttaattactttcctaagaagtctcaatattacttttccttatctcaatattctagttaatttattattcattcacccactctattttttaatgatagtcacattttatccataagaaaatcactcattttcttcctctccattcatatcttagctctttggatttacattaattttaaattctaccacttggaaatgtattttctgctgtcactgctactagcaaatgtaaaaagtattaaatagttccaaattagtttatgactctccaatcttgaaatgctccatattttaaatcaacagtgatttctacattaatttttttcttaaaattactctttctgaggttgggtgtggtggcttactcctggaatcccagcactttgggaggctaagacagaaggatcacttcaggccaggagtttgagaccagcctggccaacaaagtgagaccctgtctctactaaaaatagaaaaacttagtcaggagtgatggcacatgcctgtagtcccagctactcaggagactgagatgtgagaatcacttgagcccaggagttcaaggctgcagtgagccatgagcatgccacttcactccagcctgggtgacagaatgggaccctgactctaagaaaaaattaatgtctgaatctgattgtattttaataattccaattttgatgtaattcacaattattattattattttttttatttttattttgagatggagtcttactctgttgccaggcgggagtgcagtggcacaatcttgggtcactgcaacctttgcctcctaggttcaagagattctcctgcctcagcttcccgagtagctgggactacaggtgcgcaccaccatgcccagctaatttttttgtatttttagtacagacggagtttcatcatgttggccaggctggtctcgatctcctgacctcgtgatccacccgccttggccttcccaaagttctgggattacaagcatgagccaccacgcccagccgtattattatgattttaaacatggtgaaactaaactataacttttttatcctcatgactttcccataataatattcccaataagctattattaatgcatgtaaatataatagatgtgatattttatttaattctcacaaccttatgggtataaaattaaaactttttgcctcaaaacaaaaaatgggcaaactatagattctgtgttttacttatggtttgagaaaatcactggcaacaatctgtttaaagtcagattttgttgctcggtgctctgcctctgatgttggcttaactcagtttctgcatcctcagcaaagctgggggatgaaagcctaagactccagttaacaaccacagatgtatcattgtccttgctttgtagatgtatttatttttattttcagtcaatggtcagcatacctgcaatctgccactatttcctccagatttcctctgtaacaactgatataggaatgatgcttttatgaccctggaaaatgtaactttaaacactaactagctatctgcttgctttgtattgtttttgtttgtgtgtgttttaataaactgctctagtgatccttccatttttcaactatatcccacttccagttctgttctgtctcggaataggctcactctttgatcattttgctggtacccttgctattattactgaacattggcacatgccaacatcagtatgtctaagaaatgctcttaatcctttaaagcaggggtccccaaccactgggccacagaagggaagtgggctgcacagcaggaggtgagcatggcgcaggagcattaccaacagagctctgtcccatctcagatcagtggtggcattagattctcataggagcgggaacaggaaccctattgtgaactgcgcatgcgagggatctacgttgggcactccttaatgagaatctgagatggaacaatttcatcccgaaaccatctacccacccccactcctgttccgaggaaaaattgtcttccaagaaatgtgatccctggtgccaaaaaggttggggaccgctgctttaaagtattgtctttaagcccattgtgcagataaggaaactgagacatggtgatgttaactgtttaaggtcatacctcaggtttgtggaggatttaacacccaggcaggttgattctagagcaacattgtccaggataaatataatgcaagccacatatgtgtaattttaaattttctaataaccacaaaaaaagtaagaaaaggagagattgtttaataatatttgggtgataatgatatgtcagtacaagttcattgattgtaacaaacgtaccactccaatgggggatgttggtagtaggggaggctgttcctgaatggggtagtgggtatatgggaaatctctgtatcatccaggctggggtgcagtggtgcgatctcggctcactgtaacctccccctccctgggttcaagcaattctcctgcctcagcctcccgagtagctgggattacaggcacatgccactatcgcccgccgaatttttgtgtttttagtagagagggagttttgccatgttggccaagctggtctcgaactcctggcctcaagtgatgtgcccgcctctacctcccaaagtgctgggattacaggtgtgagccactgcccccagccatctatgtacctttcagttttgctgtgaacctaaaactgctctaaaaaaaatagtctgtaacaagtgctatctcagtctttgtttctagaattcctaaaaacacctagtgcttgagaatattctttcataatattctgtgggttttgtgcttgcctggggttaacagttgaatagatgatttatcttaatagctgattcattctgcactctgccccaccctcccacaatcagcagtttgcctatatttgcaagtgtttgtcctcatggcatatatacatagaattgtgatggggagaacgagaactgaaccctcaccatcaccatgcaggaattattttttgtgatctagagtactctacatttccttcagtcatcatagtcttttttgggtatcaacaaatcacacttcgattctgtcttctaattgttgactagattgagtgaagggagagagggagaaaagtttgaaggatgatgtcgattggccaaccagtccttctgggttttaatatgatgtacacaagataaaatcaggacatatgctaacatttgaaattatctttcccagctgaaagagaattaatgaagaaccatttgtgggtacaaatcagctcccccacttcttggtgtatttctttggacaggttacttaacctctttttggtttatttctcatattagtaaaataggcataatggtattcctctcacaaggtcattgcccagaagatggtaattgctcaataaatgaattttagagtctgtatttcatacttgtgatttacagaacaacccatgggcctactactaattgaatcaaatacatagattattatgtttctgaaaaacaaatgcctggcaaggtaattaagtttgctcaaatctaacttaacctaattcttgaaaaattcttgaaaaaagggattaatttccaataatcacatgacattgcaccgatccagcaaaacccctccaggcagtcgtagaatctcgagtcattcaaaacacagtgtttaatacattgcgcccagtaccttctgtttcttccattcttttttcttggaaaagaaaagattactgctcttgttgatcacgttgatttttagatcttgcttaacatcctctcttatagtgcttgggttcagttcttacctatgtcactgctcttaatgtgccagtattcaaaggatgaggcatcccctgcctgtctgaatgcaaaagtagagttctgatggggggaaaacagaaagagagagatttcacagacttttctttatactaaatcatgttaaatccattgtgtactttatactcacaatgcatctcagtccatgctagccatatttcaaatgctcaatagccacatgtggctagtggctgctgaactggacagctctggaatctgtacttttaaccctttattgtttcccttttattcttctttgctgtatatttcttcattataatttttataaaatttattttcaatttctccaacttttgtatcacattggaccttgaaataatccaaaatgtggctacaggaaattttaaaaatcaggccaccccccaaatatagttttaagcacacactccaaactttctgaaaactattttattcatcgtttgtggagaaatatatagtcattggccctttttcatctttaaaacatcacttaaaatcagtttaattagtatctctgggttcaaaatgaaatttaattcactcaacatttcttgggcacctgcagggacacaaactgtagtagttgctaacattaagacaaagatccctcaaaagaaggcatgtatatgttagaaacagaccgtgaatgtgaaaaaaaattgttacctgcttttttctattgccctccacagtgaaatctcaatcttagctatcagtgtgcaatactacttcacagaagacttaaagtagattataggtagattttcccccctttattttaaaggtatgttttgccttttttttttttttttgtaatttgatacagggtcttgctctgttcccataggctggagtgcggtggcaaaattatagctcactgcagcctcgacattcggggctcaagctatcctccttcctcagcctcctgagtagatgggatcacaggcatgcaccactacactcagctaatattttgggttttttgtagagacagggtctcactttgttacccagggtggtcttgaaatcctgagctcaagcaatctttccaccttggcctcccaaagtgctgggattacgggcgtgagccaccatgcccagccatgttttgcctttaataggtgtaagattttgattccctaaaagaaaacccaggtccctaaggatccatagcatggttgacagaagaaaagaatgtagttttctcctagattgcctcttttaagtcacccaggagaggaaattattttaagacagctctttttaaactgacatttgtttagataaatatattaattatttagagtaaattcagccccagctatacagaaataaactgaatttcaaatgtctccatgtgtttacacaactgctcttactacaactacagttggagttactggggacttgttaaacatcagcaattgaaatgctgtcttcatgttatctagagattgaagaaaataaaattcacttaaaaataaattcataaatactatcttaaaaatgatagttctattgagcttccatttgagcaattgtgtaatcccataactactacagagaaactaaagaagagaaattgaaaaatactttagaagataaaactattgccatttttctggactaacagaagagacttgttaaatagcaatgttgaaaagaatgtactttatgcagaaatcaaataaaatggaggcaatttactaacaaaacttccatttatatgatgtgtgtttgtaaaacactctcctgagaattataattctatcatgttcccatttgagtacttatataatcacttaagagcaataaaactaaaagagaaaatattcaaaaatatcttagaagacaaagtttttgctgtgtttctgaattattttagtggacttaacaacaaaaatagtataattacataaaaatagaataaaatggaaacaatttgcttaaaaattcacatataggtaatctacagttataaaacagtatcataagaattgtaattctctctagctttcatttgaagcaaggaatgatcacttaatagcaatgaaactgacaaaatatcaaaattgcttacgaagacagcaaaaatgcattttatgattctgatctttggaagtaggcttcttgggaggcaggatcaattctgaaggtgcattgcttctgttttcaagttgtgtgaacagaagacaaaatccagcacttgtgaagacatgtttcttgtggccagagaaggatgtgctgggccgtggccatccccaaggaaagaatccttgaggaggtccatgatggctttccagagaagagagcatgacagaaggtttgcttctcaggaacattcccctgggacacatctgtgccatctgacaggaggatgaggtagaagaacagagcctgggcagctgcttcttgtccagatggaagggttgagtctggtgtaattaaatgaccaagatcatgtgcattgtctttcctattggtctccacttctgaaggtgcatgtctctcaacatcatcaaaagaagatcttgagcattgaatatcattgaaagaaggcagcaaaggagcaccaggagaaactctccctgttgttgtggaggaatttatgtgtcctgatggagttggcctgatggaggaatctggtccacactaggcacagatcctggaaccctgagccatcccaacctaatgctccgctgtcttggtatcaggggatcctagtatctcccatgcatctgccaaattttccttttggaatatcagggacatagagatactttttaaaaagctgaaacttaagttcttcctaaatcattatttccctgagttgtggattttattttcttgagttatcaaagtttttctcagccaatagagctctcaaccaactatcaagagcttttttttcctcatgataattgataggatccaatggctttttctaatttttctagaagaattttaatttgggctgggtgtggtagctcacacctataatcccaacactttgggatgccaagacaggaggatctcttgaggccagaaatttgagaccagcctgggcaacacagggacaccctgtctccacaaaaaataatttaaaagaatattagctacatatagtggtgcatgcttgtggtcccagctacttgggaggctaaggtgggaggatcatttgagcccaggaggttgaggctgcagtgagctgtgatcatgccactgcactccagcctaagcaacagagagagagaggccctgctaaaaaagagagagagagagagacagagagagagagaattttggctaggattctgaagatgtctagcacttcagatgcatgactgattttttcatctgctttggaaagattcttctctttccatagtaaatcactttaaattgaatcttgcataatcattttattttattgatgcagtttagtaatgactaagtttctgctgaagctctgaaatctcactttcaaactggatttttcagactgcaatgaagctagtacatttttgagacttttaacattatccataagtgcatttgttattttgacttcttcaataatttagtgtagattttattgctttttccttcaagagtttttaaagatacatttaccatagccatataaatccagcttcttcagaacttcattttaataacatagatgttaatcttcatgaccttggattaggcagtggtttcttaaatattacactagaggcacaagaaaagaaaaagaaaaaacttggacttcatcaaatgtaaaaacttttatgcatcaaaggacattattaagaaagtgaaaagacaacccacagaatgggagaacatatctgcaaatcagaaatctaataaaggtttatttagtacccagaatatataaagaactcttacaacaacataaagacaacccaattaaaaatgaataaaggagatgaatgcacatttatccaaagaaaatataaaaatagccaataagcacgtaaaaagatgctcaacatcatcagttgttagggaaatgcaaatccaaccacagtgagacgccacctcacaccctctatgatggctataacaataattttgtttttaatgcgaaataagtattggcaaggaaaactcaaacttgaaccctcaaaacctgctgtgggaatgtaaaatagtatagccactgtaaaaaaaaaaaaaaaaaaaaaaaaaaaaaaaaaacatttcctaaaaatgtttcagacagagttactacagtatatgacccagaaattacccacctgggaatatatcaagagaatcgaaccatatgttcaaataaaatcttatacatgaatgttcgtagtaggcatagtttataatgggcagaaagtggaaacaagctacatatccatgagtggataaatggcatgaacaaaatatggcagacccatacattggaatgtcatccagccataaaatggaatgaagtgctgatacttgctacaatatggatgaaacttgaaaacactatcctaagttaaagaacccacacgaaaggccacataatgtttcaatttatataaaatgtctagaataggcaaatctatagaggcaaaacatagattagtggttaccaggtggaagtgggggcaggaattgggagtgactgcttaatgtgtatggagtttctttttggggtgacaaaaatcttctgaagttagatagtagtgatggctgcacaacattgtgaatgtactaaaagccactggtttgtatacttcacagtgtttttaaatgaattttacctcaataaaaaactttattaatcctcaacacaatctccattgtctgaggcattgttaatatctccaattcccagatctcattctcctatgtaagaacagcagctcaatctttcatcttctgcaagtttttttcagtttattcactttactcactcttttttatcttagcttcttgtgaaagcagatttatgcttttacaaaaatatgctttcatccaggccatcttttattgccaccttaagttttttttaaaatttatctgatatattttaaaggatgcttttgttgcagctacttgaacttggatgttcaatgcattttctgaagaccaggtctctctcataatctcttttaacccagagtaaacaatcggatatttccagattttttgcttatggccaccagtttttgtatatattatcatttgttctcaagtctggcttccattaaagcagagtgaaatctttcaaattctattcgaatgaggctaagcttgaaaaaaaaatgatgtttttcctccaggaaggcagaaaatccaatagtcagtactttatgtttatttggataaagttctattttaataatcaaaaatctgactatgactgaaaatacctttctatcccatagcaattggtgggggtctctgttaaggtttgagaagcactgctctaaactgtttctcacgcttcaggtatcagctgacgtgcacttcctcaggaaggcttttgtaatccacagtcttgagtcaggcccttaattatgaacttcaaataagctccagcctttccttcaaatatttatcatagtttatcgtcacatgctcacctccacccagaagtagctattatcctaaattttgtgttaagcctatgttttccttagaccctaccacacatgtaggtagctctaaacaaactattatttgattttgtctgttttttaaactacatctattaagtcacatcatatgtgactttctgtgacttactacttggctttcactctgtgttgtgaaattcatccatttattatgtgtagttgcagtgtattcattttcactgctgtataaaattccatgatatggatagatgacagttttgtaatccattttaatgtcaatagaaatttcaattgtgtcaatgttttttgctgttaggaacaattatgggctattgtgcaatggagtttcttattgtgtctcttgcttcacatgtacaaagaatttttttttagtttaacattaggggtagaattgcttggtatatgacacatgcttacttgactttactaggtgatgacaaattgcttttcaaagttgttgtagcaaatcacaaccccaccaggagtgtgtgagtttacaatgctctatattcttgtcaaaacttggtattgtcttatttttacgtttatgccagtctggtggatttaaacagtttctcattgtggttttaatttgcatttatctgattactaatgagactgaatcttgtttcctgtgtttctcggcatttggatttcctcttctgtgaagagccttttgctcattttctactgagttatttgtctttttccttattgatttgtaggaattattcatagactctagatactaatttttgtgcattatatatattatatgactatcttctcccagttatggcttctcttttcattctttttaccatgtcttttattgaaaagaagttgttaattcttacgatttattaccttttgctttacaggtggttcttcttgtactttgtataagaaaacctttcttaacctaaggtcataaagatattccagcctggcatggtggcgcacacctgtaatcccaacactttgggaggctgaggcgggcagatcacctgaggtgaggagttcaagaccagcctggccaacatggtgaaaccttgtctctactaaaaatacaaaaaaattagctcacgttgtggcagacgcctgtaatcccagctacttgggaggctgaggcaggagaatcgcttgaaaccaggaggcggaggttgcagtgagccaagattgcgctgttgcactgcagcctgggcaacaagagtgaaactccatctcaaaatgtaaaaaataataattttcatattttctcttgaaagtcttaaggtttacatttggaacttcagtgtttgatccacatgaaattgaattttgaatatggtgtgaggcaggaattcattttcatatgagtcttttctggtgtaaagcaagcctgggggtaagcgattcaaacattctactctgtggtatattttctagaaagacactcttgggcagatgaaggagaaatgtatgaacaagttcatggaaacattactcataatagcaaaacactggaaatgtccccaaatgtccatgaataatacagtggacaaatactgggtttgtgcaaaagtaattatagtatttgccattactttcaataataataataataataataataataataaaaaattggtgtatgtgcctacaatgcaataccatacagcactaaaaatgaaaaatctatagccacacgtgacaaaacaaatccttccaaaacacctaattttgagtaaataaccagattgtagaagaactcataaagcaagattccatgtatgtaacatttaaaagtagaaaaaattgaacaacatagtagttagagatatatatgtgcttaaactataaagaaaagcaagagattggttaataaaaacttaagagcagtgactgccaatggcagggagggaggtgcctgaagtcaggaatggacacacagggtgcttcagagctaggagatgggacatgtctcctctttctttctaattccaactattccataatatcgctcccagtgctgacttcctgaagcccaggtctaattatgcaacattactgaccttcttaccctccaatcatcctgtaagtttattggagttcctagaattctttccttggctctctttttatatcatgttacagggcgatcttagtgggtgatttcacccatccccatgactgtcaactgccactgaagtggcaatgactcacacatttgtctttcctaaactccagacctacatatatagctactgagtagatatttccgcttgcatgttccacagtgtctcagactcagtatgcctggtgtttttacaaaaaggggaaatttgcacacatagggagaagaccatgtgaagatggaggcagagattaggtgatgcagcagaaaccaaggagcatctagagagccagcaaaccaccagagcttgcggacaggccttcagaaggaaccaatcctgctgacaccttgatcttgaacttttagcctccagagctgtgaggccatacattcctgttgtttaagctccccagtttgtggtactgtgttccagcagccctagaaagtgaatgctatatgcacgcttgccatcccaattttcacacccagtaactgatcctataaaaataattgcacaagtaagcaaaggagttatcataaggatattgacaacagcagtgtttatcatttacaacagagaaaacaacctaaatgtcttacagtgaaagaaaagttcataaatgatagtacattcacacaatggaaagtcatgtagcttttcaaaatgatgttgtcagtataaagcttgagagggaaagacattcacaataagttgcttaaaggggactacaaaagagtatgtatatatatactgttggccattttttgcaacttatatatgtgtgtgtgtgtgtgtgtgtgtgtgtgttataaatgcataggaaaaagtctgaaagtatatcaacatatttacagtggtagaatttcaggtaatttacattttcctctctttgcttctccatattttcttaagagatgtggtttaaaaattagcctgtgagggttccttgttttccctctccccattgccccttttaagattgactgagtagattcacaatccttccataccttgggaaggaggaagaaagaataggaaaaaaggggaaaggacaggagaaaagaaaacataaatgatctattaaagaactaggggataaaaaaaattgtttgtttgtttgtttataagagatggggtcttgctctatcacccatgcagtggcaccttcttagctcactgcagctttgaactcctgtgctcaaatgatcctctcacctcagccttccaagtggctaggactgtagtggtgcctcatcatgcctggctaattttttttgtagtggtggggtcttgctatgttggccaggctagtctagaactcccggcctcaagggatcctcttgcctcaacttcccaaagtattaggaatacaggacagcgtgcccagccagattcatgaatttaggaagcaaaatatagtgtgaactgtaggagaaaaaggtttggggaggtagagttgtgaatgagaggctctaaagcaatacagggtgtgagagaattgtggaagagagaagagagcataggaagagtattctcggggttacaaatgggatccttttaaacaatttccaagtaatgcacatgaaagctcagaatttcatgttttatcatttttagctgttgggattgtacttctttgaatgcagcatcaacagcatacagagaaaggattcaatgagtccaggatttataaagtcatttttctacaattagcatatgggttccagtttgcaaactgaagtacacaagaaatattactttatttttctctatcttcatttttatttgttgttattgtcctcccagtggcagacacttggcctcaggcaactaagttttctgcttgagataacattcaagaggaggtaggtgtgggcagaggcttagttaatgaggttcatgtagaatgcatccgggccagaggtcttaggacaacggtatcttttaagatggccatcatcctagctgaccttaagatctgcatgatcccatctgtcaacacaagtccctgtcttttctagtctggtgagtctctttgctgggccaattctgtttttgagggaagggaaacactcactaggcccctcagccacactgggccatgactaccgtattcctcaccacactgtgctgtgggaaaactctggggtcttgtcacctgcagggctcaatatgtgacttaggcaggggcccatagatccacttacaccatcagatggttaatattgtcaaattgattggattgaaggatgcaaagtattctttctgggtgtctgtgagtgtattgccaaaggcgattaacatttgactcaatggactgggaaaggcagacccaccctcaatgtgggtgggcaccatctaatcaactgccaacttggctagaataaagcaggcggaagaaggtgggagaacctgacttgccttcatttttctccagtgctggatgcttcctgaccttgaacatcagactccaagttctttggctttaggactcttggatttacactagcagtttgccgaggggatctctggcctttggccacagactgaaggctgcactgttggcttccctacttttgaggttttgggtctcgggctgatccactactggcttccttgctcctcaacttgcagacggcctatcgtgggactttaccttgtgatcgcgtgagtcaattcttcttaataaactgcctttcatatttacatatatcctattagttctgtccctctagagaaccctgactaatacagattttgttcctggagtggttcaagaattttaaggatagagttctttagttggtttcagggtttctggaattggctgctcaatctgattagacccaaaaatgctaagacctctgctttgaatactatggaaaacactgatagtccttggtgtgaactgtttagaaagttatgcaaaataaatgcatttgatactcctgattcactgctctgcagaggcaaggagtttagtgactctatacataatacctttgaccatatgtggagaatcaaggaatgtcataaagttgtttggttgctcctaagtttgctggacaaagtgatgaaagaaaacgatgaactcagggattctaactcctggctccagaagcagatactgagccccaaatcttctaagactgccctaacagagagttttatctcctgtatagaaagagctgaaattgtggaaaaacagacacaagctcttatcatgtgagtggctgacttgcaataaaaggtgaatgcacacccttgccaggtgtctactgttaaagtgagggcattgattggaaaagaatgggaccctgcaattaggaatggggatgtataggaggtccctgatgaggcttgggacactgagcttctaaattctgatgagccttttttgccagaggaaacagccttcccatctgcagcagtagcaacatctccccccaccacccatgctgccatcagcctttccacctttgtctgaggagattaaccctgcactgcctgaggcaacagtgatggcctcccctgaggaagttgccaggtaagagaatgctgattctcctcaggacccacccctaacacccctgtttgcttccagacctataactagactcaagttccagcaggctctagatgtaaggttcagagtgtgaccaatgaggaggtgcgctacactccaaaagaacagagttttctaacttataaagcagaaatctggagaacaggtatcgggatggactttaagggcatgggataatggtggaaagaacataaagttggatcaggctgaatttactgatatggacccactaagcagggattctgcatttaatgttgcagatcagggagttaaaaaaaggttctaataatttatttgcttggttagctgaaacatggatcaaaagatggcctacttggctgggcgtggtggctcatgcctgtaatcccagcactttgggagaccaaggcgggcagatcacttgaggtcaggagtttgagaccagcctggccaacatggcaaaacccagtctctactaaaaatacaaaaattagcccggcttggcggcacactcctgtaatcccagctactcaggaggctgaggcaggagaattgcttagacccaggaggtggagggtgcagtgagctgagatcgtgccactgcattccagcctgggtgacacagtgagactctgtctcaaaaaaataaaataaaataaaataaaatatggcctactatgagtaggctggaaatgcctgatctcccttggtttaatgtagaggaagggatccaaaagcttagggagattggaatgttggagtggattagtcattttagacctactcatcccagctgggagggtccagaagatatacccttcaccaatactttgcgaaatagatttgtgaagggagcatttacatccttgaagagttttgtgattgcttatctttgtatgccagatcttacagtgggaactgcagtcactcaattagaaatgttaaatgcaatggaaataattggatcccaaggtggcaggggccaagttgaggcactcaaccatgaaaggcaaggtggatgtagttactataatggacagcaaaggcaaagtagcaatcagaatagcatgatttatgtagagctctggctttggctaattaatcacagtgttcctagaagtgaaattgataggaagcctactgcatgcttacttaatttatataagcagaaaactttcaggctgaatggacaaaagactaatttgaattataaaaatagagaattacggcctgtcaatcatttccagacatgaaccagtttacagacccagaaatccttgaatgaaagggacgccggttctccttgaggaagaacctcactatactaccaacaatttatgcagttaatctttttcccatccttccctaaggagacctctggccttttaccagggtagctgtgcactggggaaaggggaatgatcagaactttcggggattctggccactggctctgagctgatattgatttcagaggacccaaaacatcattgtggtcctccagttaaagcttggttagctaaaatacggatcttatggggcttgtggagataaggtaattaatgaagttttagctctggtccgacttacagtgggtccagtgggtccccagactcattgtgtggtcatttccccagtgccagaatgcataattggcatagacatacttagcagctggcagaatccctacattggctccctgactggtagggtgaggcctatcatggtggaaaaggccaaatggaaggcattagagctgcctctacctagaaaaatagtaagtcaaaaacaatatcacaaccctggagggattgcagagattagtgccaccatcaaggacttgaaagatgcaggggtggtgattcccaccatatccccattcaactttcctatttggcctgtgcaaaagacagatggatcttggagaatgacagtggattactgtaagcttaaccaagtggtgaccccaactgcagctgctgtaccagatgtggtttcattgcttgagcaaattaacatatatccttgtacctggtatacagccattgattcgacaaatgcctttttctccattcctgtccataaggcccaccaaaagcaatttgccttcagcttgcaaagtcagcaatataccttcactgtcctgcctcaggggtatatcaagtctccagctttgtgtcataattttgttcacagagatcttgatcacttttctcttccacaagatatcacactggtctattctactgatgacattatgcggattggacccagtgagtgagaagtagcaaacacagtggacttattggtgagacatttgcatgccaggggatgggaaataaattcggctaaaattcagagaccttctacatcagtgaaatttctaggagtccagtggtgtggggcctattgagatatttcttctaaggtgaacaataaattacctcatttggtccctcctacaaccaagaaagaggcacaatacctagttggcctatttggattttgggggcaacacattccttatttgggtatgttactccagcccatttatcaaatgattcaaaaggttgtcagttttgagtggggtccagaacaggaaaatgctctgcaacaggtccaggctgctgtgcaagctgctctgtcacttgggccatatgacccagcagatccagcagtgcttgaggtgtcagtagcagatgggatgctgttcgaagccttcggccagcccccataggtgaatcacagcagagacctctaggattttggagcaaggccctgccatcttctgcagatacctactctccttttgagacacagctcttggcttgttactgggctttggtagaaactgaaggcttgattatgggtcatcaagtcaccatgcgacctgagctgcttagaaggcacaagtaagttacataaggaaatggctcaaatgcccatgatctccactcctgccaccctgtcttctctccccaagcctgcaccgatggcctcatggggaattccttacgatcagtctacacaggaagagaggactagggcctggtttacgggtggttctgcacgatatgcaggtaccacccaaaagtggacaggtgcagcactatagtctctttctaggacatccctgaaggacagtggcaaagggaaatcttcccagtgggcagacctaccctcaatgtgggtgagcaccatccaatcatctgcgaacttggctagaataaagcaggcagaaggtggtgggagaagccgacttgctgagccttccagctttcatctttctccggtgctggatgcttcctgccctcgaacatcagactccaagttcttcggctcttggacttacaatagtggtttgccaaggggctctcgagcctttggtcacagactgaagctgcactgttggcttccctacttttgaggtttggggactcggactgatccactactgatttccttgctcctcaactggcagactgcctatcgtgggactttacctgtgattgtgtgagtcaattcttcttaataaactccctttcacatagacatatttcctattagttttgtccctctggagaatcctagatgggattctgtcattcccagatttttccaaggtttccgccattgcttccccattttctcaccaacttccttccaacacatatgccatgggtttgacttctttctcacagacacttactgatattttagttttctgcattatctccagttctttctcttcctttggtcctggaaaatcttgccacaattttgtgttgtccagattcttcttaggcctctgagcatttcttcattgtcttttcttttggatatttgttccatcatctgtccatagaatattcagcttctagcattccacttttggcccactgtctttctcagtttttcccaggttacctcatccactcccaaggatttaaccaccacttctatgctaatgactctgaacctacagctttagtccaaaatccatgtcctgttgctgtgtatctgtccttgatctcccacaagccaataaaactaaacttgtcccaaactctatatatcttccgaaaacctgtatttttctcttgcattctttctcttcagtggtggatataattacaaactgctcggctattatggaaaaatgctcagtgctttgaggatgtttagtagaggcactctctatctgtctaggatggggagggggatgcgagaaaatgttctctcacttagatattattgaggctggcatctccagatctgcacagctcaggagtctgactgcatcacttccttgccccagaccttcaggaaaaacatgcagtggtgtacccagggggtagccaccttgatagagaggagcgtgttatcattgtttagaatcactggcaatatagtcagttttattattgttttctaatactcaacagacagtctaccccctttttgcctacacccagcatggtccactcaaattgccctactccttggtactccactgaaaacctggaggcctccaccctcctctccttatccccatcttcccttcagccaagcctctaaggccaaatcacctgttgtttctcatttctgtgtcttttctcatgctcttccctctgcctggaattccctctactccatacacacactgtatctggtttacccctactctttaagattcaacttaaatatcgcttcccccaggaagctgcccctgctcacccaaggctgagtcacatgcccttcgttgggcttccatggtatcttctaaatactaaatttctgcattggccacatcgtactctaattaatctgttcatgattttgtctctctcaattactgtgtgccaaatgaagtagtcttattcacttttttattcactgagatccgaggaaacactacattattcattttcatatctccgggatctaggaaaatacttgtcacaatattgatgagaaaggtgtttacatcatgttgtgatataagctttaaattctgcagaacacttattttcatgggaaaaataatatttggagcatgcccttagggtctccctccacttcctttcctggtaccctttagaaacccttatgtgaaccttcacatatatatggaaggctcaggttggtcttcaacaccactgccttgatgctacaaatttacaaagtggaagacatttttcagttttgaagcatgctcttctccagctctctgcagagcttctgtttctgcaagacagtgactgagagtctggtattcaattattattttattcatttaactgcaccagtaaatagtgatagaattcagaactcagagctaccacaatatggaatttttaaaaggcacttgaaatccttgacagcagaagcagggacatttaaaatacagaggacagggaaccaaactgtgaaatgttctctctgtaatcttcatcaaagatatatgctttgaaatgattcctattccatggaagaagatacaatctgctccccctcttcccattaccaccatttgcaaagcaccacccagtcttacagatattttcttcccagtgtctctcataaccattcctttcttaaggtttcgtaagaaccatatgaatgttctttgacatcatatcatattatatgcagtgattctttaaatagtattccagtgttgagatagcgaaaagcactggaagcactggtgtgctggtaaatgtttcacaatcagctctctggggaaagaagctctattggtagtgtttgctaatctccatggtataaatactcccaccaaggcagatttcaagctatcaacttgatgtcactgaatgaggagttggggaaaggtggaccccattgtctctactgaaccaatacaagctgctgtatatcagctctagcacatttctggatggacgattaatttttctcaagcaccatttaagataggttattttcagattcagaaatctacccagacttctactgtctgccatggaaatagaaaaaaaaaaacagtctgtccacttttccctatcaccacaaatactgtgttaggctacttgattggagtctgcattagctagttaaatgatctccttggttccactcttacctctacagttcttctccctacagcaaccagagtaattgtttaacactaatttgattgtgttacctgcccagaggcaatattgcatcacaccaggaactatgccactggtgcaacatggagttgtgcagtacgcaggctattcaaccatactcagcaccccgacctctgcttaaaatcctcagaggttttccattacatttagggatttgtatatttgtgtttatataacatatggtttaacccggtctccaaaggcctgcatgatctgactgcagcttcctctcctgtcccatccatgccactctccctctgacttacttggttccagcttctctgaacttcccaacttccttcaattcctctgtcatactaagctctctctaggatcccacctggaccactcttctttttgattttcctttggttaaactttctttctgaagtctctgctcacaaggcactttccagagagatctttgaacccctgatctaaattaagccccttcaattagtctctttcatggcatgttattttttcacttctaagcattacagtgggtactgtcattatgagtgttttggtgtcaatgatggcaggctttttttttgttttgttttgtttttcaccagggatgtagaacctccaaatttactgcgaggggcacagccacagtcccgcaaaggtgacaagatgtgctcgctgtttgcatctgtttaaatcatcactataagaaagtgattcttgggtttaggtatgagtgatggcagtttttatgaccagaaaagattatttatgatgagtttggtttttagaaattaatattccatttaaggttataagatcaaaagactatttgtccttaagctttaaaattcaaaataaaaatcacattgttctattaatgaataaataagactttaacagtcacttttaagggggcctttgattaatgtgtgagcccatttacaaacttaattttaattctttttttttttttttttttttgagacggagtctcgctcttttgcccaggctggagcgcagtggcacgatctcggctcactgcaactgcaacctccgcctcccgggttcaaacgattcttctgcctcagccacccaagtagctgcgactacaggcacgcaccaccacccagctaatttttgtatttgtagtagagatggggtttcaccatattggccaggctggtctcgaactcttgacttggtgatccgcccgccctggccttccaaagtactgggattacaggtgtgagccaccacgctggacaattttaattcttaaacatcaaaaaattacattcatacatttaatgtacttgttttcattttaagtcattcaactgtgtaacaaaaataatttaagtaactctaacatatgaaacataaatatggtgaatattaggttcttctgaatgttccaatagtatctttaaatttagtaaagttttcttatacattgaacttaaagtcagaagttaatcaattattcaattaaatattatacattaaattataaagcaattctgtttgattcgctcatctgctattaataaattctccaaataattacacgtattctaaatagcaagtgcacaaggtgtttctcaacttaccatgaatatatgaatacgatgggtttggcttaatcagttttcataattcactcttttattttcaattacagatcctcctagaattaaaatgggcagatgaagcagacagttataccacaccaaacatttggtgttatttttcaggaggaggtcactgaggatacaaattgactctggatttggctgggactcagggttttgtgttctcccaacatactgaggcccagttacgaggcctagttacaggaatttcatagccagaaagggtcccatgttcacgtccctaattctagtgaaatctgggtctgtaacccctctcctaggttctttcactttgagattggattgatttactctttcaatggctttattttattctaaattatcttcttattcttctgagcaggccaggctcagctcttattgatatttaaatagaatccagttgggattccacaaatctctttgtagttttgtatatctccatttacaatggcaagatcagtcttaatgacaggaatggatctcaatctacaaacgcaggtctgcaaaaactcttattttctaaatatgtgactcaccattaatttaattaatttttctaggtaaacacaaggcatgggattgttacttgctacaaggcaagacatacaggaaggggctggcagggactcatggtgttaaggtacaagggccaagttacctaccctactggaattttttgttctgggggctcactttctgggagttgcagcagcagctgcagcaacagtggatgataatgagcaacagcaagaacaacagggtgctgacgaaggtgaggaagataatgtaggcagcagtgtcccacttggactgaaagggctgatccctgtcagctgttggtctccccacacttccagagccattactcccagctcctccatgaacaacagacccattttagcagaagcgccctggtgccaccttttaaaaatatactagacaagcaccgtgaaacacatgggcactcagccactgttgactttgtgaacaaaagaaagaaagagaggctgggtgtggtgactcatgcctgtaatcccagcactttgggaggcctaggcgggtggatcacgaggtcaggagatggagatcatcctggccaacatggtgaaaccccatctctactaaaatacaaaaaattagccagatgtggtggcgtgcacctgtagtcccagctactcgggaggctgaggcagggaattgcttgaacctgggaggtggaggttgctgtgagctgagatcatgccatcgcactccagcctgggtgacagggcaagactctatctcaaaaaagaaaaaaaaagagaaagaaagaaagaaagaaaaagaaagaaaaagaaagaaagaaagaaagaaagaaagaaagaaagaaagaaagaaagaaagaaggaagggagagaagaagcaagggagggagagaggaaagaagggagggagggagggaaaggaagagtaggctttaatttacaatttgaacccttattcaacaggaattgaaaatgatatagagtcagtactcacccttccctttcctcctgatatttcatctgggttccaggtgaactcagtgacatcaagttggacagcttgagacttgccttgggtggagtagttacgcggggaacaagggtttctaaacctttagaatttcctaataggactcttttgtaattcataacatgcctctttgaatcatacctgaccacatgctaatgagagaattcttaacctctagagagcttcagaatagagctgatcaccaggcgactttcagccccatcccctaacccctaactgtggagaggggaagagggtctggagattgagttcaatcaccaatggccaatcacacctacataatgaaatttcagtaaaatctcttgaacaacaaggtttagggatgttctgagtttgtgaacatattgatgtgctgggtgggtggatgcccagagagggcatgggctttctgtccaccttccactcccttgctagctctatgcatctcttccatttggctgtttctgaatcgtattctttataataaaactgcagtggtaagtatagtgctttcctgtgtcctgtgagtctttctagcgaattatcaaacctggtggagggtggggagtgatatggtttggctgtgtccccacccaaatctcatcttgaattgccatgtgttgtgggaggaacgtggtgggaggtaattgaatcaggggctcagttcttttccatgctgttctttatcagcatgatatgtctttatcagcagcgtggaaatgaactaatacagggagggtcatgggaatccccaaatttgtagttgattgagcagaggttcagttagcttggagccccatatccggctaacatgtgaagtggaggcattgttatgcaactgaacccataacttgtggggtctgcactgactccaggtaattggtgtcagagttgaattgaattattggacacccagttggtatcaaagaattggagaattggtggtccttggaaaatgacagatttgctgtcagaaaaacaatgctgtgcttcattggagcactgctcctgtgtgcctagagatcactttgctcttctgcaccaaagagaagcacaggtggaatctgtgaggtttcaaagtccaagtgcaaaggcttctacaaagccatttctactcagtgttggtcaacttgctgggctgggcctggagaatgtgagcaccagtctcttttgctcttatgaagtccaaactaatcttgaatttgtcatcccctggaggttggcctgggaaatgagatggggtggaggctccattttgcaaagacccaacaccacctaagttctaatcacttccctctgactctcctctatcctggggaaaagttgccagtctctgggccagaatagccttgctctgattcagtgagtatcttctcaaatcactattcatgacagaagttatattctatgcctactgaaaactggaattttggaactcaagagctaggataaggtttttgttagttatatattggattctgcaattcatctatcttctgcatcattacatgcagaatactgagctgattgaatgggtaagagccaaaggagaacaagtaatgctgggaacaaaacacacaatgagtaattttccaaaatattaactcagcacacactttgaccatttgtataaatgcttatggaatagtatttgatgtcagttttccactagactgtaaataccatgaggacagggattataccttgcttgttcattattgtacaaaaagtacctagaacagtatctgcatccaaaagaaaatcaataaagatttgctgaagtcattaatgaatttaaactccttagtttgacattcaatatctaagtgataactccctgctctcataagctaattttattcttgtagtcaccaactttctatatcacctgaattaatacagttatcagcttctatctgtcacttattcaagaccagatcatttatttgaatatattgttttctttgctaaaaatgtcctttctccactataataaaacatcttcccctctttcaaactatgccttaaaactgatccataaacaacctcatgattgacctcacttgtctgtacactcagtttcattcattcatccctttaaaaatatatattgagtagtctgtattggacaccattctaggcactggggataaaatgtaaatgaaaagctctccgtccaaataaataaaacatgaatgaggtatttttaaatagtgataaaggctattaaaatacaaacaggccgggcgcaacagctcacacctgtaatcccagcactttgggaggccgaggtgggtggaccacttgaggtcaggagttcgagaccagcctggccaacatggcaaaacccatctctactaaaaatacaaaaattagccgagcatggtggcaggtgcctgtaatcccagctgctcgggggggctgaggcaggagaattgctcgaacccaggaggtggaggttgcagtgagctgagattgtggcattgcactccaggctgggtgacagagcgagacccagtctcaaaggaaaaacaaacaaaaaacatgggacagtgtgtgagagaaagtgatcaggggacaacagaacaacattagatagtgattcaggaaagtcctaggctgggtgccgtggctcacgcctgtaatcccagcactttgggaggctgagttgggcggatcacctgaggtcaggagttcaagaccagcctggacaacatggtgaaaccctcttttctaaaaatacaaaaattagccaggaatggtgggacacacctgtaatcccagatacttggtaggctgaggcaggagaatccttgaacccaggaggcagaggttgcagtgagccgagatggtgccactgcactccagtctgggtgacagagtgagaccttgtctcgaaaaaaaaaaaaaaaaaaaagcagtgattcagaaaagtcctgtctgagcatgtgatgtctgagccaaggtctgaatgaagggaagatgtgaggatggagcatttctgctaccatttttgtcaggagagtgaacaggtgcagagggcctgatgcaagcatgggttggggttcctggaaaagcataaatgaagcctgtgactcaagctggagaactaaggaggagtgtggtaagagaggagagcagagaggcaaaggtgccaggtcaggctgggccctgtgggcaaggaacaggagtatgcattttgaacataagggacacctggaaggctctgaaactgggccatgtcatggtctgattatctttcagaaatgtatctagccactgggttagggatagaccaaaaaagtgaaagcaaaaagactagaatttaattgcagtaacatgaaatgatagctcagcatgaactaggatggtagtgaaaatggagagaagtggacagattagagacctatgcttgaggtcaagccagtagggcttgctgatggactggctgggcacgggaatgaagactagggtaaatggggaaacaggagaatcaaatttgaacttgacttctagatctgggttggtggtgccatatgctgagatgtgggaccaggaaaggaaagattaaggtggaggtaacgggcaggagtccaatgttctatttaattcacctccaacatgcctattagacatctgggtgcagatgttgagtatgtgttgggatatataagcctggatcccagaggaaaggcagaacaggtggtggtgaaaagagcagactctggactcaacctggctcccacctatgtaggcttgaacaatttactta

SEQ ID NO: 22 - DNA, 40001 bp, Homo sapiens
gtattcaaagattgaagcacgctcatactttgtatgtgctttagggaaggggtgggtgggcacttgggccttgcgggtgcattcatgtaatctgagactcttgaactttatgacggagtcttcaatattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataattatgttttgttcttgtggtttgttgtcattataaagtgctttttttgaagttctgttcttaggaggttctgtttttaatttagttggacttacatgttgatccttgtcagaaatgccctgtagatggcaaaactctttgattgaaaaggaccatttcttttgaaatcttctacacccagtgttagcaaacttacctgtgcttcagaagtgtttgggaagctttttattttaaaaaagtacacatttctgaaccttacttctgattcagattgaatcagccttttggggtgcctgagcatttcagagcttctatccagctagcctagcactaaggcagtatgacttgttggcggggggaaagtatctaggctagaattcatttctccccaggtgtagctggaagtttatcatctttttggtgctccgtgttaggcagaagacaaagcagatagctccctctagtggtaggaaggctgcttatccaaagacctagcagtaatgatctgggattttaataaaagtagagttctttggaattactttccacattataatacactttttacttcttaatagcaaatagatcccagctgtacatgccaaatcagatgagtgtgttagtagccttttggacaaatgtcactgtgtgtcaggaggaatatattatgtggttgtaacagaaaacctcaaaattatagtggctttaaaaccacaaagatttatgtcatgcacgtacattacaaggatatcctgtttggtgcagacactatcctgtttggtgcagacactattgaactttctggatggtcatgccaaagggaagactgcaaggctgtacaccagcaattacacgttcctccctggtatggacatgtcacttccactcactcccttggccggaactactgatatggccccaccagccacaacagcacagaagttgtcttccacgtcctagaaagagagcatatcagtgaccagcactctggtggagcaacttcattttacagattatttgaaatttgggagcacacctgtgaatggttccaaatatacctctgacttaatttgttatttgtccttacatactggacagtagcattgtataatgccatccgtattcaaaatctagccattttgtaatagcttccaactcactgcagagtttttgacttaggaagaagacaaagtttaaccacctggtttgttctactgaagagaagatgagaaaattagattcagttcctcttctattatgcttgatcaaattgagagaatcatcagttcccttatgagtcctttttaggtcacttttcttgtctacttaatggtttccagtgttttcagacagtgcatacctattttcacgcatcaatattcccttaaaaactttgtaataaggtctgtcaccttatgcactttgccatcaaaattagtactgtgacaatcctttatcagtcctcttggatttagggaaatggacagcacagagggataaaaggggcttgcactaagggcaggagctctggattataattctaagtcctctgtgatctttgattagcctttgtttttctgggcatcagcctcatctgaaaaaaaatcatcactgaagtgtcattctgtttcaggttttgcccatctgtatttttaatcctcaccactgactgagtaatgagcttcatatttttgaacagttttaaactagagacagatgcttcatttttttttttaatatgctgtgctacatattaaacttacctaagattcggttcaccactgtgttcccagtgtctggtatagggcaggagcactctaaatatctacagaatgaacaaaggaacttagcaggtggctcctcatatccaccctgtagtttaaaaatggcagagaattctattctttccagaggcagagagcataatattgcatggcaactaaatgaagtaatttctgtgagtgggttttgatcgtcttaactgatcagatcctgaactcagtttctagagcagaaattacaaatttggggccttctgggggaaatctgggctgataaattttgctttgttgttaggcctcagtgatagatttattttattttatttatttttttgagatggagtcttgctctgtcacccaggctggagtgcaatgtcacaatctcagctcactgcaacctccgtttcccgggttcaagtgattctcctgcctcagtctcccgagtagctgggattacagacatgtgccaccacacctagctaatttttgtattttaatagagacagagtttcaccaggttggccagactggtctcgaactcctggcctcaagtgatccacccgcctcggcttcccaaagtgttggaattacaggcatgagccaccatgcccagcctcaatggtacatttttaaatgatattttaaaaaatatttgaatcagttgccaaccatttaaaaattgcaagattgtatatgacaaactcaatttctatcttcttgtgaaaaattggaagtgctggctgcataggccactcatccttgcttggcaacagtccgcataagctgggatgggctgagtttctaattcacccctgtcgtctccaccacagcttgctctagcaaattagattgctgtcatcagactcttccgtttgcttagaggatgccgtaagtgaacactgggcaaattcgacatctcatttaatcacagtcaaatcctatatgaatatgtatagtgcagatattcggtattgattaaagtgaaaagattaaaaaccagaagcaatgtgtataaatttgacattcatttatggaagtatagaacctgtttgtttttctttaatgaccggagtgcagtaaaagaaaaaaaaaatcaatgagcaagtgttttatttgaagatattttcaatttggatctatgctagaattttgcattttggtatcaccaagttgttccatgagcagtgtttctcaacctttgatgggcgttggaagcaggttgggaagcttgtgaaaaatacaatgccggccgggcacagtgcctcacgcctgtaatcctagcacttagggaggctgaggcgggtggatcacctgaggtcaggagttcaagaccagcctgaccaacatggtgaaaccccgtctctagtaaaaatacaaaaattaggtgtggtggcacatgcttataatcccagctgcttgggaggctgaggcaggagaatcacttgaacctgggaggtggaggttgcagtgagccaagatcgtgccactgcactccagcctgggcaacagagttgagactccatctcaaaaaaaaaaaaaagaaaaatacgatgcctagacccagtgccatagattctgactgggtaggtttgggatggagcctggtatcttaccttttccaatttttcagatgattctgattctatggaaatgtgagtacctttcatttaaatattcctgctatttcagtgagagggggctgcttgttcttggatctaccatttttatggaagaagattcttagagaagaaatacacatgaggtttgcctctgggaaacattggtggttaaggatttcagcaaacattacaaccgatggggtttctgcagtgaagcagcaaagcctggccgacacattatgcaggtgtgcatgtgccatctggcctaatctaccaaccttttttggttggttgaccacccaaaagtgtctcaagctatttatatttgaaggtaaaatgctgttagcaccccctccacctcctctttcccaagcatatggaattaaagaatcacagaattttggaagcaaaccagccttcagagatctagatcagtggtcctactttacaagagagccaattatcgatgtgtccaaggccacacaattgatggcaaagcggggaagggtgctcaggtctcctgaatccagtccaatgctctttccgttacaccttctcacctcaaaaagatccaaacacccatgtgtattttgctgcattcaataaaacttatattaactttaaagatgttacacgagagatgtgaaaatctgaaacaatttctgagatattataatatttaaaattatcaatttgagatcaaacgtctggcaaattatgtaaaaagggaaaacaaacagtaaaaaaatatgggatgtagaataaatcttagtatacggcaagccacaacccatcaagatttggagttggaaactgttggctacaaaataccaacatttaatattaaatacgtaccatttaatataaaaatgccttctgcatattagttaaagccacagatctgtgcagactgtgtaatcacactatttgcaggaacagatgggctgtgtttaaaataggagtcaagccttagtttagagaattttaaaatataaaactgcttccttcccaagataagtattaaatcgtcctaagaaacacatgtgagggatagatagacataaacattgtaaattcccattttttttctctagttgattagaaaatcttttctgaagtcatcttcccaaaattaccttgaaactcatcccctacccctaaaaagaaagcccaagttttaagggggccattatgtttatttttgtaattatgagctacattgtgcaactcaaacgaataaacttgcaagatggtgacctctgtatgtgttttggtgctggtgctgttgctggtgggggaccgatatcggaaaggccatgtatgttagaaaagtatgttcacaggagaaggaagccaattcgctgagctaacttgtatcataacattttagactttcaacctgtatctcacaggcttacagcctgcctccatgccattgccatttatcttttgttatgggtttaggttttttagtttcttctacatttaagaagaaaaaaagcacatatagcttgaacaaatgatacctgataaatgaatatgctcagctgggtgaggtggttcacacctgtaatcccagcactttgggaggctgaggagggaagatgttttgagcccgggagattgagatcagcctgggcaacatagggagaacctgtctctacaaaaaattaaaaattagccaggcatggtggcatgtgcctgtaatcctagctgctcgggaggctgaggtgggaggattgccaaactggggaggtcaaggctgcagtggctgtgatcatgccactgcactccagccagggtgacagagcgagaccctgtctcaaaataatagtaataataataataataataataataataataataacgaaaaaaaggaaaagaaatgcttgccaccaaagtgtacttgttatttcaagggaaaggaaaaaacaactttctttttaaaaagatgagacgcaatattaactacttagaaaaagaacttgaatatttaatttaattaattaatttatttttaagaccgagtcttgctctgttgcccatgctgtagtgcattggtatgatcttggctcactgtaacctccgcctcgtgggtttaagcgagtctcctgcctcagcctccctagtagctgggactgatctgcccacctcagcctcccaaagtgttgggattacaggcgtaatcccacctcacttacaggcgagccaccgtgcccagccagaacttgaatatttttaatgtaatatggggccgaaatatacttcttaaatcacacatgcaaataaaaacaaacattttgcttagtcaaatgtatgtgtatatatagattacattccacttaggagatgtgtggatgcaacaaaaaaagaaaactgcagcccaatatcactgataaacatagatgcaaaaatcctcaacaaaatactagctaacccaatccaacagcctatcaaaaagataatacattatgatcaagtaggtttcacaccagggatgcagggatggtttaacatatacaggtcaataaatgtgatatatcacataagcagaattaaaaacaaaaaatcatatgatcatctcaatagatgcagaaagaacattttataaaatccagcatccctttatgataaaagccctcaacaaagttggcacagaaaggacatacctcaaagtaataaaagccatctacgtcaaacccaaagccaacatcatactgaattgggaaaagttgaaagcattttccctgagaactggaacaagacaaggctgcccatttttaccatttctattcaatgtagtactggtagttccagccaaggcaatcaggcaagagaaagaaataaagggcatcgaaattggaaaagaggaattcaaactgtcactgttcaacaatgatatgatcatatacctagaaaaccctaaagactcatctgaaaagctcctagatatgataaatgaatgcagtaaaggtctcaggatacaaaatcaatgtacaaaaatcaggggcatcactatacatcaacaacaaccaagctgagaatcaaatcaagaattcaatcccttttacaacagctacaaaaaaaaatacttaggaatatacataaccaaggaggtgaaagatctctacaaagaaaactacaaaacactactgagagaaatcagagagaacacaaacaaatggaaacacatcccatgctcatggatgggtagaatcaatgtgaaaatgaccatactatccaaagaaatctacagattcaatgcaattcccatctaaatgccatcatcattcttcacagaactagaaaaaacaatcctaaaattcatgtggaaccaaaaaagagcccacatagtcaaagcagtactaagcaaaaagaacaaatctggaggcatcacattacctaacttcaaattatactacactgctatagttacccaaacagcatggtactggtataaaaataggcatgtagaccaatggaacagaatagaaaatccagaaataaagccgaatacagccaactgatcttcaacaaaacgtacaaaaatatcaactggggaaaggacaccctattcaataaatgatgctgggaaaactggcaaaccacatgtagaagagtgaaactggattcttatctctcacttcatacaaaaatcaactcaagatggattaaagacttaaatctaagacctgaaaccatgaaaattctagaagataatattggaagaactcttctagacactggcctagacaaagagttcatgaccaagaacccaaaagcaaatgcaacaaaaacaaagataaataaatgagacctaattaagctaaaaagcttctgcacagcaaaagaaataattagcagagtaaacagacaacccatagaatgggagaaaatattagggaatgtaaactaatacaatcactatggaaaacagtatggagactccttaaataactaaaggtagaactatcattagatccagcaatcccactactgggtatctacccaaaggaaaagaagtcattatatgaaaatgacacatgtaaactcatgtttatagcagcacaattcacaattgcaaaaatatggaaccaaaccaaaagcccattagccaacgaatggacaaagaaagtgtggcatatatcaaggaatactactcagccataaaacggaacaaaataatggcctttgcagcaacttggatggagctggaggccattattctaagtaaagtaactcaggaatggaaaaccaaatatcgtttgttctcccttataagtgagggctaatctatgagcatgcaaaggcataagaacaatacgatgcatgttggggacttgggggaaagggtggaagggggtgagaaataaaagactacatattgagtacagtgtacggtgctcaggtgatgggtgcactgaaatatcagaactcaccactaaagaacttatccatgtaactaaaaaccacctgtatcccaaaaaccattgaaataaaataaaaattataaaaagatggttggatggaattcaataaactcagatgcaatgtgatacattcagaatctagtaggaaagtaccatttggccaggcgcggtggctcatgcctgtaaccccagcactttgggaggcgggcagatctcttgagaaatttgagactagcctgggcaacatgacgaaatcctgtctctacataaaatatgaaaaattagctggatgtggaggcacagttgtactcccagctgtggtcccagctacttgggaagctgaagccggaggatcgcctgagcctgggaggtcggagctgcagtgagccatgattgtgttactgcactccagactgggtgatgaagtaagaccctgtcttggaaaaaaaaaaaaaaggacaattagtaacacatcattgtatgacatgaactttgagggtcccccgccaactgccccccaccagcatggggatgaggagatcagtgtgtgcctagtcattctcactgaattaaccaattcttgcagtgactactaccatgtacttaaagagagaaatagtctgaaaactagagaactatttgcctttcctctcctccttgggctttgacccccccaggccttatttaccctctgttctggtcaactgagctaatggtccatgttatccaaacatctgacacatacatcaaaagaaacactatgtcctttttactttcttttttaaaaccatactatttatatttatttatttagttatttgttctagttttattgaggtataattgatgaatgacaattgtatatatttaaggtgtacatgatgtttgatatgtgtatatattgtaaaatatcaccacaatcaagctaatttacatatccatcacctcacagtttccctttttttcccatatgtagtgagaacacttaaggttcactctaagcaaatatcaagtatactatacggtatcattaactacagtcaccatgctgcacattgggtctccagaacgtattcatctcataactgaaagtctgtacctttgaccaacatctccccattttccctagccccaatcccttctgtttctatgagtttgacttttttgcattttatgtataagtgagatcatgtggtatttgtctttatgcatcttatttcacttagcataatgtccttcaggttcctccatgttgttgcaaatggcaggatttccttcctttttatgctgaataatattccatcatgtgtatatgtgtatgcacacataccacatttttaaaatcaaatcatctatcaacagacaggttatttccatatcttagctattgtgaataatgctgcaataaacacagatatgcagatacctctttgggctactgatctcatttcctttggatatatacccagataggattgctggatgatgtggtagttctatttttaattttttgaggaatctccatactgtttttcatatggctgtgcaagtttacattcccatcaacggattacaagggctcccttttctccatattcttggtaactcttgttatcttctgactttttttttttttttttgagacggagtctcactcttgttgcctaggctggagtacagtggcgcgatctcggctcactgcaacctctgcctcccaggttcaagcaattctctcccccacgcttccccagtagctgggattacaggcactagccaccacaccaggctaacatttgtatttttagtagagacggggtttcaccgtgttggccacgctggtctcaaactcctgacttcaggtgatctgtctgcctcggcctcccaaagtgctgggattacagacatgagccaccgtgcccagcctctgactttttgataatagagattctattataacaggtgtgagatgatatctcattgtggttttgattttcatttatctgataattagcaaactatatcctttttactgatagtctccaagaaaagaatagctcacactctgtggccttctaatccctttatgaataactcatgaactccttagaaccccctgtaggcattatcatctacatatccagatgaggaagctgaggcagagtttgatgtcttgctcaaagtccacagcagtaagttcttgcacctacacagtctggcttcagaatccacttaagcaatacattacagtgtttattcacagacacgtattttttggatttttcattcttgcacttaaaattggaggcggtagtagggaaagcatcttaggaagtaactcctggatgcttttatgtgctggggacttcaccagtttcattcattcagtagctgccacaagatgacccccaccccgaagacctcccacccctgttctttgatatagacacctggcattttctccagagtcccacccgcaagccctccctgttcccagctagtagcttgctttccctacgtctccatggcatctcaccaatacacatttgtaagtagcccttaggaaccagatgcagactaacaccagacatcacccctgccctcacagaactctcatggggcacttggaagactcacagttaaatgataacaataaagtgtgattatttttttaaaggagcaccaaacttttctacctaaccatggctgttggcaaagtccactgctcgtaaattcagtcactaaggatggatttaagcttgtcgctcccagattccttttcaccagatgtgggaaaaccttcaaatctttacaactgagtatactgccttgccttctgtgaggcatacccgccgctcccccaaaaccagctttatcaacactgtggagacaggttctcagactcaagagagagtcccttagcatagtggttctcaaactttgctgcacattgagatcacctggggtcctacacccagacattctaattttgttgggctagggacgggaattcttagaagctcccttagtgattccagcgtgcaccaaagcttgggaatcacagtgtcccaagagatcagcactttgctgttctgttgccgttgacacctgagatagatcttctcgcgacagtgtgcctggtttgtagcatgatttcctccactctgaaccttggtattctcaacaaccaatcttctcttaaatcagcatcaggcaagttcaatgactttcatgctgctgctaattttggggctcagacctggcgaactggcatctgtgagctgaatctgactggcaaacttcttttgttttgcttggatggtgattctaaaaaaattgaacatttaaaaatcaggctgggtatggtagttcatacttctatgaaccactatgctaagtatgaactcccactttgggaggctgaggtggaagtatcacttgaggccagaagttcaagaccaggctgggccacacagggagacctggtctctgtaaaaaatgcaaaaattagctggtgtggtggtgcacacctgtggttccatctacttgggaggctgagggaattgcttgagcccatgacgttgagggaggccgcaatgagctgtgatcacaccactgcactccagcctgggtgacacagtgagacactgtctcgaaaaaataaaaaaggtgagatttcacacaaaaagtatggattcctggattctttggaaaaattagaaggtctcagcccatttccaccataatattcatcaggagcccaggggcttctgccctttaacaggcacttactccctcccacccacccagttcactaggtcctacccagatcccaacatttatgttatccgtgacccctgaagatcattattcctttttggtagttgcttttttttattattattatactttaagttttagggtatatgtgcacaatgtgcaggtttgatacataggtatacatgtgccacgttggtttgctgcacacatcaacttgtcatttacattaggtatttctcctaatgctatccctcccccagccacccaccccctgacaggccctggcatttgatgtcccccaccctgtgtccaagtgttctcattgttcaattcccacctatgagtgagaacatgcgctgttttgttttctgtccttgtgatagtttgctgagaatgatggtttccagcttcatccatgtccctgcaaaggacatgaagtcatccttttttatggctgcatagtattccatggtgtatatgtgccacattttcttaatccagtctatcattgatggacatttaggttggttccaagtctttgctattgtgaatagtgctgcaataaacatacatgagcatgtgtctttatagtagcatgatttataatcctttgggtatatacccagtaatgggatggctgagtgaaatggtatttctagttctagatccttgaggaatcgccacactgtcttccacaatggttgaactaatttaccctcccaccaacagtgtaaaaaccttcctatttctccacatcctctccggcatctgttgtttcctgactttttaatgatcaccattctaactggcgtgagatggcatctcactgtggttttgatttgcatttctctgatgaccagtgatgatgagcattttttcatgtgtctgttggctgcataaatgtcttcttttgagaagtgtctgttcatatccttcacccactttttgatggggttgtttttcttgttgttgttgttgttgttgtaaatttgtttaagttctttgtagattctggatactagccctttgtcagatggggagattgcaaaaattttctcccattctgtaggttgcctgtttactctgatggtagtttcttttgctgtgcagaactctttagtttaattagatcccatttgtcaattttggcttttgttgccattgcttttggtgttttagtcatgaagtctttgcccatgcctatgtcctgaatggtattgcctaggttttcttctagggtttttatggttttaggtctaacatttaagtctttaatccatcttgaactaatttttgtataaggtgtaaggaagggatccagtttcagctttctacatatggctagccagttttcccagcaccatttattaaatagggaattctttccttatttcttgtttttgtcaggtttgtcaaagatcagatggttgtagatgtgtggtgttatttctgaggcctctgttctgttccattggtctatatctctgttttggtaccagtatcatgctgttatggttactgcagccttgtaatatagtttgaagtcgggtagcgtgatgcctccagctttgtcctttttgcttaggactgacttggcaatgcaggctcttttttggttccgtatgaactttaaagtagttttttccaattctgtgaagaaagtcataggtagcttgatggggatggcattgaatctataaattaccttggacagtatggccattttcacgatattgattcttcttatccatgagcatggaatgttcttccatttgtttgtgtcctcttatttcgttgagcagtggtttgtagttctccttgaagaggtccttcacataccttgtaacttggattcctaggtatttcattctctttgtagcaattgtgaatgggagttcactcatgatttggctctctgtgtgtctgttaatggtgtataggaatgcttgtgatttttgcacattgattttgtatcctaagactttgctgaagtttcttatcggcttaaggagattttggactgagacaatggggttttctaaatagacaatcatttcatctgcaaacagggacaatttgacttcctcttttcctaattgaataccctttatttcttcctcttgcctgattgcccgggccagaacttccaatactatgttgaataggagtggtgagagagggcatccttgtcttctgccagttttcaaagggaatgcttccagtttttgcccattcagtatgatattggctgtgggttggtcataaatagctcttattattttgagataacttccatcaatacctagtttattgagagtttttagcgtgaagggctgttgaattttgttgaaggtcttttctgcatctactgagataaccatgtggtttttgtccttggttctgtttatgtgatggattacgtttattgatttgcatgtgttgaaccagccttgcatcccagggatgaagccgacttgatcgtggtggataagcttttcgatatgctgctggattcagtttgccaatattttattgaggattttcgctttgatgttcatcagggatattggtctaaaattctctttttttgttgtgtctctgcaagggtttcgtatcaggatgatgctggcctcataaaatgagttagggaggattccctctttttctattgatcggaatagtttcagaaggaatggtaccagctcctctttgtacctctggtagaatttggctgtgaatccgtctggtcctgaactttttttggttggtaggttattaattattgcttcaatttcagagcctgttattggtctattcagagattcaactttttcctggtttagtcttgggagggtgtatgtgtccaggaatttatccatttcttctagattttctagtttgtttgcatagaggtgtttatagtattctctgatggtagtttgtatttctgtgggatcggtggtgatatcccctttatcattttttattgcatcttttcttctttattaatcttgctagcagactctcaattttgttgatcttttcaaaaaaccagctcctggattcattgattttttgaagggttttttgtgtctctatctccttcagttcttctctgatcttagttatttcttgccttctgctagcttttgaatttgtttgatcttgcttctctagctcttttaattatgatgttagggtgtcgtttttagatctttcctgctttctcttgtggacatttaaatttccctctacacactgctttaaatgtgttccagcaattctggtatgttgtgtctttgttctcattggtttcaaagaacatctatatttctgctttcatttcattatttaaccagtagtcattcaggagcagcttgttctgtttccaggtagttgggtagttttgagcgagtttcttattcctgagttctaatttgattgcactgtggtctgagagacagtttgttgtgatttctgttattttacatttgctgaggagtgttttactttcaattatgtggtcaattttagaataagtgtgatgtggtgctgagaagaatgtatattctgttgatttggggtggagagttctgtagatgtctattaggtctgcttggtgcagagctgagttcaagtcctggatatccttgttaaccttctgtctcgttgatctaatattgacagtgaggtgttaaagtctcccattattattgtgtgggagtctcagtctctttgtaggtctctaagcacttgctttatgaatctgggtgctcgtgtatggggtgcatatatatttaggatagttagctcttcttgttgaattgatccctttaccattatgtaatggccttctttgtctcttttgatctttgttggtttaaagtctgttttatcagagattaggattgcaacccctgcttgtttttgctttccatttgcttggtagatcttcctccattcctttattttgagcctacgtgtgtctctgcacgtgagatgggtctcctgaataggaatacagcacactgatgggccttgactctttatccaatttgccagtctgtgtcttttaatttgggcatttagcccatttacatttacatttaaggttaatattgttatgtgtgaatttgatcctgtcattatgatgttagttggttattttacccattagttgatgcagtttcttcctaccttcaatgttctttacaattgggcatgtttttgaagtggctggtactggttgtttgttcctttagtgcttccttcaggagctcttgtaaggcaggtctggtggtgacaaaatctctcagcattttcttgtctgtaaaggattttatttctccttcacttatgaagcttagtttggctggatatgaaattctgggttgaaaattcttttctttaagaatgttgaatattggcccccactctcttctggcttgtagggtttctgcagagacatgtgctgttagtctgatgggcttccctttgtgggtaacccgacctttctctctggctgcccttaacgtgttttccttcatttcaaccttggtgaatctgacaattatgtgtcttggggttgctcttctgggggagcatctttgtggtgttctctgtatttcctgaatttgaatgttggcctgcttgctaggctggggaagttctcctggataatatcctgaagagtgttttccaatttagttccattctcttcgtcactttcaggtacaccaatgaagcatatacttggccttttcacatagtcccatgtttcttggaggctttgttcatttctttttactcttttttctctaatcttgtcttctcactttatttcattaatttgatcttcaatcactgatattctttcttccacttggtcgaatcagctattgaagcttgtgcatgtgtcacaaagttctcgtgccatggttttcagctccatcaggtcatttaagttcttctctacactgtttattctagttagccattcgtctaaccttttctcaaggtttttagcttccttgcgatgggttagaacatgctcctttagctcagagaagtttgttattaccgaccttctgaagcctacttctgtcaactcgtcaaagtcattctctgtccagctttgttccattgctggtgaggagctgtgatcctttagaggagaagtggcactctggtttttagaattttcagcttttctgctctggtttctccccatcattgtggttttatctacctttggtctttgaagttggtgacctacagatggggttttggtgtagatgccctttttgttgatgttgatgctattcctattcgttagttttccttctaacagtcaggtccttcagctgcaggtctgttggagtttgctggagttccactccagaccctgtttgcctgggtatcaccagcagaggctgcagaacagcaaatattgcagaacagcaactattgctgcctgacccttcctttggaagcatcatcccagaggggaactcggctatatgaggtgtctgtcaacccctactgggagatgtctcccagttaggctacatgggggccagggacccacttgaggaggcagtccgtccattctcagagctcaaagatgatgctggaagaaccactgctctcttcagaggtgtcagacaaggatgtttaagtctgcagaagtttctgctgccttttgttcagctatgccctgcctagagaggtggagtctatagaggctgtaggccttgccgagctgcagtgggctccacccagtttgagcttcccagccactttgtttacgtactcaaacctcagcaatgtccaacgcctctccccatgccaggctgcagcctcagaggtcgatctcagactgctacactagcagtgagcaagactctgtgggcatgggacctgccgggccaggcacgggagagaatctcctggtctgccagttgctaagaccatgggaaaagtgcaatatttgggtggaagtaccccgtttttccaggtacagtgtgtcatggcttcccttggctaggaaagggaaatccccgaaccccttgtgcttcccgggtgaggtgatgccccgccctgctttggcttaccctctgtgggctatatccactgtccaaccggtcccagtgagataaaccaggtacctcagttggaaatgcagaaatcacccgtcttctgcatcgatcgtgctgggagctgcagaccggaactgttcttattcgtccatcttggaatggactggtagttgcttttgtttatcttttgctgaatattgactgtatatgcacagtgctttcctaccatgatttgcttcaaaacaatttctactatagaaccaccaatctcatttatgtgcacgcgcacacacatgcacacacacactactttccaggtttggtatccttactttcatattcattttttcagataacttccagtgcttttttcgtagcttccagatggcatagggttagtggtgtttttcaaacatcacaaaactaagcagaaacccaaaagcatgtagcagaccaagttctagaattcaaatgcctacagggatcaggtagatgacataagggggtaaaggaggccagctgaggaccacagagacttgaagagcacttgctccacttgcaggaagcagccctccccaactaccctccaggggtacggatcaacagaaattctgctgtgatgaaaatgttttgcagctgggtgcggtggctcatgcctgtaatcccagcactttgggagaccaaggtgggttgattgcctgaggccaggggttcaagaccaacctggccaacatggtaaaagcacatctctactaaaaatacgaaattagccgggtgtggtggcggatgcctgtaatcccagctactcgggaggctgaggcaggagaatcacttgaacccaggaggcagaggttgtagtgagccgagatcatggatcatgccactgtactccagcctgggcaacagagtgaaactccatctcaaaaaaaaaaaaaaaaagaaaagaaaagaaaatgttttgcatctatcctgtccaatacattagccattagccacatgtgactatcaagcagttgagtgtggctagtgagactgaagaattttacattttagttcatttttattaacttatatttaagtagctatatgtgcctagtggctaccatattggaatgagtcagctgcttatcactgaacagaaacggatatgggtccagtgtggttagatgtactgattttttttttccagatcatccaggaacccaatccatatgtttagtgaagtcttttccatttaaaatgttggctccatttaaaaaaatgttacgaaagccagccaggcacgttggctcacccctgtaatcccatcactttgggaggctgaggcaggtggatcacttgagatcaggagtttgagaccagcctggccaacatggtgaaaccccatctctactaaaaatacaaaaattggctgggtgtggtggtgggcacctgtaatccctgctactcaggagactaaggcaggagaatcacttaaacccaggaggtggaggtggcagtgagctgagatcacgccactgtactccagcctgggtgacagaatgagactctgtctccaaaaataaataattaaaaatgctatgaaaaccaagcaaaacacattgatggggggaatcataactgtgaccatccattggtgtcccctaccatggattaatgaacaaacaagggcagagggaaaaataccctgcacatctgttggtagaaagcaaaaggtacaattaatgggttatttccctgaggcacagccttacttgcaccaatgaatgtttactggttgaaaatttgtcagtggcagagcttatatacatctcatcctatcatatgaacgcatatagcatgtgacatgtaggctgagacataaaggatgaagaagtatttacatgagtgagaacagtgacgcaaggacccagaggcaagagagaacatagctggttggagacttgaagaagttttacgtgtttgctctgtccgctatggcagccactcctcatatggctttttacatttgaattaaaaatgtttcaaaaattaaaaattcagtccttcagtcccattagccacatttcacatgcccaatgggcacatgtgatcagtgatgactttggactttacagatacagaatatgtccattattgcagaaaagtctattggacagcactagagcttagaggctggaggaggctaaggaaagagggcagagagggggcatcatgagagaggaggctagacacatactcacaaccatgaggtcatgggtgggttggtacaccaccttaagaagtttggacttggtgctgaagatttgcctttcagtaaactcacactgctattgggtggacaatggacaggaaggaggacgcgagtggatgccagagatcagtcaagagactgtggcagtcaaggtaagagaggaggatgctcagggaccagacatcctccatgatccacaatgctttgcccaggacctattgtacagtcatcccttataagtgccaggtctagaatatgtactcaaaatagccctcatcctacaggcgaggaaattgaagtttgcatggttaaatacattaaccccacagaccacacaactagtaagttccagaactgtgattctaacacacagctatgtaactccaaagtctatatatatatatatatacacacacacacacacatatatatacacatatatatatacacacatatatatacatatatacacatatatatacatatatatacacatatatatacacacacacacatatatataaaattttattttattttatttttttgagatggagttttactctgtcgccctggctggagtgcagtggtgtgatctcagcccactgcaacctccgcctcatgggttcaggcaattctcctgcctcagcctcccaagtagctgggattacaggcacacaccaccacacccgctaatttttgtactttttagtagagacggggtttcaccatgttggccaggctggtctccaactcctgacctcaaatgatccacccgcctcggcctcccaaagtgctggattacaggcatgagccactgcgcccagcccagatattttttattgttgcttttcttctctatacaatgtttgcttcctagaagagacagcaaggaacacagagacagaggagcaggagctctaggcctggcagagtgaagtggaactgggcagggcagctcccggagggcaggaaagagtctctgcatcacaatcatgtgatctaaggaaaactaaccccacaccaccctaaatgtcatgtctgggagggtgctgtgtcgctcagttcacacctggtaccaagttctgttcaatttcctttattttcaaggcgtatgtagcagtgtgcctattaatacatacagcaggcttattatgaaggagaacaacctaaggatatgcaatacacattacctgtcaattgacgttttgctggtgaccaattcattcccttttgcatcaaattcccccccccccagatccagtgactcactctctcaactgcatcctggccagcactccagtttctttagcgggtggaagaggctaaggaaagagggcagagagggggaatcatgagagaggaggctagacacatactcacaaccatgaggtcgtgggtagggctggtgcaccaccttaagaagcgactccagatccagtgactcactctcaccactgcatcctcgccagcactccagtttcttttccttttaagatgaggataattatatttcagaggagcttttgtttatttgttcatcgccagcttcctctagtccaaacatagatggttggttggttgggttcaatgccaggacccaacctggatagccagttttctgtatgtgatgacattaaatgtgtgaatttttataaaattgtgtgtacctttgaggaatttttcaggcatctagggaatttgaactagtaatttataatagatttccttgactagcaaggtaattccctaatgaaaagagcggcactttatctcaaactgtatgcagcagtggaaagaaacttaacaggactttgacattctcaagcttctaggtgcaagtttacttgtttattttgctcttttttttttttttaaaaaaaaagacaatttaaaattctttaaaatcttattttacctttttttgtaacttttattttgatttaatttcaaatttacagaagttgctagaacttttatgtacccttcacccagattcaccagttgttaacattttgcaacatttgattatcctattacaataggatgtatttgattgtatttcttcacaatacacacacacactctcacactattatttttgaaccacttgagcataagccgcagatgtaatgcccttttaaccctaaatatttcagtgtgtatttcctaaggcaagacattttcttacataactacagtaaaatgatcaaaaccaaacaatgtaacacaggtacagtattattatttaatctgcagtatctacttcacagaattatttagctttcacccatcatcgcaataatgtccttcagtttgcagcgcctcccctgaggtcccttgcagaattgaccccgggattatgcattgttttcagttgtcatgtctctttggtctccttaatccgaaacaattcttcacgccattttgactttcaaaacatttatatttttatttatttattttattatactttaagttctgggatacatatgcagaacgtgcagatttgttacataggtatacatgtgccatggtggtttgctgcacccatcaacccatcatctacattaggtatttctcctaatgttttccctcccctagcccccaacccccaacaggccccagtgtgtgatgttctacatttatatttttaaaaagaaatacataacaataccaatagattatagatttagacataatctatacatgcatatgtactctataatatatctaaagatatgtaatatctactatataacctattcatgatagactcatgaattctagatccatagattgtagattgtgtaagcattcatgagtttattctaataaataaatgcaaacatgcataagcgaatcgggaaagcccctctttgagtaaaatgttaactaataaaatggagaaaggaatgacagaattagaaaattatcattttgcaactattataataataattgatttaggcaagaattatccatggatactaaaactagtggatgaaagtttgaaaaggaaaatgatgcttatatagcctcaaaatattgtccctcaaatcattaagaaaggaagaacagtaactctacaggagataaacttgggagataacacggtaaccaagtgactgaagttagcatcgccaatgatagaacaagccttcatcatgtacctcttgacataatgcactaaggaagatactccttcacctctgagatattcttgttaagaataatctaatcatgaggaaatagacaaacccacactaagagatattctacaaaacaatgtttcctttttaatgacaagcctgcttaagtcaagggttgtatcaagagttgcattttcacaaagtaaaccatgagatattatcttacaacagtcagacagaatagcaattattaaaaagtctaaaaacaatagatgttggcaaggatgtgaagtaaagagaatgcttatacactgttggtgggaatgcatattaatacaacctttatggaaaacagtatgatttctcaaagaactaaaaataggactaccatttgatccagcaatcctgctactgggtataaacccaaagggaaagaaacaattatataaaaaaagatatttgcactgatatgcttatcagagcactatgcacaatagcaaagacatggagttaacctgactgtctccatcaatggaggattggataaagaaaatgaagtaaagatataccacggaatactacttagccataaaaaagaataaaatcatgtcttttgcagcaacatggatgaaactggaggccattatcctcagtgaaataattcagaaacagaaagtcaaataccccatgttctcccttataattgggaactgatcaatggatacacaggaacatacagagtggaatagacattggacactacaaaaggtgaaagggtgggagggtcgtgagggttgaagaactacctgttgtgtacaatgttcgctatctgggtgatgggcacccagtagtgaagcctagacttcactactaagcatgtaagaaacctgcgcttgtaccctctaaatatgtaaaaatatttttaaagttgcattttcaaggaataccactagatgtcactgtggttttgcaggttgcacaaattttatcagtaaagacataaattccttggtggcctgcctcttgactttgactcatttctagactgggcacatttagccaatttcaacacatatagcctttgtgaagcctacaaattaaataatggtaaaagcaacgaggaaggaggcagccggcttaaagcttgtttctgcaattacaagccgtgggagccgggcagttactgctccgtctctggacttggtttccacatgtggaggagacttggattgcctgctcttagtctcttcaagctctcgtagtctatgactttaaactgatgttttttcaactaaaattatttcagtgccccttacaagatttttgtccaacgacattgaacccactactgatttttgttttgttttgtttttaaactcagagcttttatttatatagtacttgtttttaagttgactcagctttttaaaatgtaaataaagaaaaaaatgtcataggcccatcacaagtggaaaccagttcacttgccataaataaaggtaaccacaaaaataaatgtaataaaaacaacgtaatataattaaattcaagcgattgtttgccaaaggctcagagcatgagtctactcttttttcctcctttttttaaaagggagatttggcagtgttgaagaggagttgaagacagaccagccccgagactttcctttcaatgtcagcagaagaattgagactgagaagacctttctctctgtgcagtttacaaaaccaaccacaatacttcatgtaccgtccaaaaccagtctcatgcttttataagctgttctaagctataagattcttttttttttcttattcttgattcttcaatatttctaaagggcatgattagaaatcatacattattaaatgttttcttcaacatatatttaagctttcattttattttggtatccatttcagttttgtattggtttaacttccctttaatgtttatttaaatttgcctttacattcagtcttcttccacttaaaacactcactctctttttaacagaggaggtgatatatacccctctgctgtcaatgtcgaagcaattacgtgccaccaaatggcttgtgatgtgccatctcctcctgataaaggctcatgatagataggatgtggcagaggtcaggaattctgctgagtacaacctgagggtatccttcaaattgcttgagctttctccaaatcccctaggacacaatcagaaaacgagtcccctttaattttggtgcagagcttttttcttccttcttcacagagattcagagtgaagatgcgttaggctgagccatctaattgcattctttactccctaacattagtttagccctttcctgctttgtatcatctattataattactaatttgctggccacaattagcatagggggttttatagaagcagaaacaatttcttagctgcccaatgttactaaataatttaaaaaggggaagacaacgaatttccatcaaatgtgctttgttttcttaatgcatgtgttgccattaaggaaaaccattataaggtaaagaaatcaggaaattcataaagatcaatacaccaattatttcctgcattataaaagttacctcttcataattttcttttcctggtgaggtagatttaatttgctattagaaactcaaaagctgagaggtcagtttcactgttcaaaacagactgctctttgtctagcaggaaacaatgttttcccaaaaaaaagtccagagagatcacatcccccaaaaaaatcatcattgaaaaggttgattatgaatcaatagaaacttttttttctataacaaattatgttgaactatactgtaccccccaggccccacccccaaatcagagtaagaatctcttgggggttttttgtttgttttttgttagttttcatcactgtaactatgctgaaattcaaagcagggtgggcagatattacacaacttcatgaaatatactaaatataccagtggaaatcaaatgtgaggcatggttagtttctgctggcagacttacttgagattttctgaagaattcttcaggtttcctccagccccatttgttcctgatgctgatcagtgttgatgattccattatcttctttatgttacagattcctccctcccccaatgttcactctattgttttattatgtgttgacatcagcctgcggacgatggtgttctggcagagtccccttccgtggctttctgaataccactggtaagtgtactttgagcctctttctggaactatatccccagggctgcaaattatacttgatttcattgtttgcaagtgtgtagagccaacatgtctgtttaagatactgagccaagtattgtctttccagtacatctataactattgattcctatgagagaggcctaattatatttgtgcttatcttaaaaccacagcaatgaaagaggctttaaaaattccttcatctcatctagggcctgggtccgtccccatcccctatcagccttctgtggtacaagtaatagaaaccaactctgggcaagttaaaccaaaaagggtatttgtgttattgaaagggggtctccagaaataaaaaggcagctgaagaaccaggctaggacgactcaggaaccatgaagattctggggatctaggtgacaggcactgaccagtggtgtcacccagtggtgactccaaggagatatttgaggatatttggaggaactttaaacccctccatcctaccctaattctttgtgtgagaagttgagctttcttacctttatgcaaaatgctatacgaagataggttaaagtggtcccccaaatcctgccctcaacagactgccagccccatcccttctacatagaaattataaggctgccattgaaacaaccacggggggtggtcagctttgcatagtcttcccaaccccatacttaaccactgcagagaagagagtcttggggaagaaagtccatctggacaatcttaggtgtgtgaccacccttcggccagtgtcactgtttaagtcaaggctgccacaatagaggagaggtaattcttcacagggaaaattgagggctgttccccaagggaaagagaatggccaaaaaacatgtggccactaccttaccaagagagtgagaatcactttcagtgatattggctgtgctgactcttcaagtagcctcttgagaagatctggtggttgcaaatcctgcctttccttgaagagagctcagccacccacacccttcatggctttcctctactgatcctggctacacattcttgagctcatccaaagcacgtctttcagatgtttgatgtcagcttgcaagtcaaactctctttgcaagttgctctctccttctctagatatttttgggagctctgaactagctattttattttgctgggttgcgcttgccccaaatccttacatgcctgactctatttcacccttcagttctcagctcaaatttcatcttctagatgagacctaatcggacaaatcaagctcaaggccctcgtactcaatgcttctctctgtctgccaccctgcatactctttattgcaatatgaaattacttttttggggtttactttttgtctatctttcccatgaaactaagctttaagttccatgagaacagagaccttctctgtctttgtattactgtatatacttcttgcctagaattgtgccttttagactaaagttgcccaataaatatttattaattaaataaattaacaaattaacatgttttatacaactttttagtgtaatatataatatgcaaggagaaacatgcattagactatatgcacggttgaagagatggctctaaagtgaggatttgttaaccactacccaagtcaaaaaacagaatagtactggaatccaagaaacgatctttgcacttcatgtatccatttccaatcaaaaccccttcttcccctagaggtgactactatcttcacttacatgataatcatttacttgcttttctttatagtattatcacctgtacactcatccctaaaccatatagtttagttttgtcgcagttagaactagatataaatggaattgtattatatgcacttatctgcacaataattatttcactaataattacttcatataattatttaaaataatctattatgtaattatattataattagtacattattattatattatataatattattatctattatataagtatatatttatttatattagtggaaatactgattacaataattatttcacatatatttagtatactatatgtacttatctgcataattattttactaattattagtgaaaataattatataattacctataaaactatttataattatttttaaaaaattatactaattatatgtataattagtataagtacatataattatacatatgattattttataaataaatgtttataaataattatttttacaataattagcgaaataattatgtaataataattagtataattatttcactaattatcatgcagagaagcacatagaaaaaatgattttaaactttcaacttccagcatgatggaatgagaaggcagagaaattctgtcctcaaaaagcaactattaagttggtcaaaacttcaaaaccaacaatttcagtgctctgaaagttgaccaaaagcataccacaaactgatgaaatgtcctgaagtttgggtaagaacagcatgagtctgtggtggtgttgcccaggctgctcccatcccctccctccccgcctgccagttctgtggtggtagttcaaccagcgggggccaggtcatggagacccacagccttgttgctgctgccagaaggtgctccttgatttggaatgttgtcagttaaagtggcaatcttagtaacaagtggatagggagagccagcagctctgctagtctgagattatggccctatttgggacaagcggtggaccgagaggcttccagggatttaacagggacgcacagatatgagatagccccaggggcttggtaatctccccacatatcctgtgttgacgagaggctgtgctcatgtgctacagagataagcttgaacccaggccattcacacatgcctggccaatagaacctgcacacatgaacagaagagaaataagaaagcccaacagaaaataaaagtcaagcctgacttaaaaacttcctaagttttgaatgtactccccactccacacatagcccattagcaaagagtgaaagcctcactggcttgaggggtttgagtgctgttgctgaccattcttaacctgaactctaagctgtcaagggcaattcctaggcatccaggctttaaaatgtaaacaaagataaaaactgatcaaagtcaacagtggccacacgctttatagatttagcccaggcaagttactaagttaaaaaacaaacaaacaaacaaacaaacaaacaactctaggaggaaaaaatcacaatccagagtggctgcagtattagctaagatgttcaatattcaatataaaattacaaggcatataaagaaaccaaaaggatgaccaaactgagtctactgaaactgtctctgagtgtttccagataatgaatttagaagacaaaaatttcaaagtagctattataaatgtgttcaaagagctgaagaaaacaatttttaaagattgaagcaaaacatgacaacaatgactgaatagagaatctcaataaagagacaaaaattatttaaaacaaatgaaaattctgaagttaaaaattctaactgaaatgaaaagtttactacagaagcttaactgtaattctgagctagcaaaagaaagaactagggctgaacgtggtggttcacgcccgtaatgccaacactttgggatgctgagacaggcagatcacttcgggccaggagttcaagaccagcctggccaacatggtgaaactctgtctctactaaaaatacaaaaaaaagtggccaggcatggtggcatgcgcctgtaatctcagctactcgggaggctgaggcaggagaattgcttgaacctgagagacagaggttgcagtgagctgagatcataccactgcacaccagccagggtgacagagtgagaccttaaaaaaaaaaagaaaagaaaaaagaaagaaagaaagaaccaggaatttgaaaagagagcagtgaaaattaccgaatctgaaaaatagggagaaaaaagatgaaagagaaatagacaatcctatagacctgtggaataatattaaatgtaccaacctaggtgtaatgggagtctcagaaagagatggaaaggaaaatgagatagaaaaacacctaaaagtaatggccaaaaacatttcaaatttgatgaaaatatattaatgtacagatccaagaacttcaaagaatttcaagtaggatatacacaaaaagatcctccttagacacctcagaattaacctgttgaaaaataaatacaaagagaaaatctcaaaaacataaaaaaaccccacaacacagaggaacaagaatcctagtaacatctgatttcctatcagaaagaatggaggccagaaaagcagtagaaagctatattcaaagtgctgataggaaaattttttaaaagcctgcaaacttagaattctacatcaaacaaaattatccttcaaaagtgaatacaaaaataaagatgttccggaaataaatgaatattgaaagaattcctcactagcagagctgctttacaaaaatacagaaaaggtctgttaggctgaaaaaaagtgacaacagaaaatagctgtaatcctaaagaataagcgaagaatgtcagaaataacaaatatgtgggaaattgtaaaagtctctagaaataagtttttctcatttttcttttaatttctttaaatgatacaagactgtataaggcaatacttataacaatctagttgtatagagttaatatagagacataatctatacaacataatagcactaatgaagggggaaaaaagagatatattagagcaagcttatccaccccatggtctgtgggccacatacagcccaggatggctttaaatgtggcccaacacaaatttgtaagctttcttaaaacattatgagatttatgcatggaatttttttaaagctcattagctatcattagtgttattggattttatgtgtggcccaagacactttgtcttccaatgtggcccagggaagtcaaaaaattggaaacccctgtattagagcaatgtttctatattttaccagaaatgacttagtattattctgaagtagattgtgataagttgaagtgcatattgtaaaccctaatacaaccactaagaaaacacctaaatgacatatagtaaaatgtacacagaggaattaaaaatgacacattaaaaatatttatttaacacaaaaggaggcagtaaagcaggaacaaaggaaatacatgagacaaacaacacacagcaaaatggctaacataaatgcaaagattatcaacagttacattaaacatgattggactaaacactcactaaatactccactcaaaaggcagagattgtcagactgaatgaaaaagcaagagccaattatatgctatctataagagatctgttttaggttcaaaggcacaaataggttaaaagaaaaggatggaaataatataccatgtaaacattaaccataagagggttggaatggcttttatcagacaaaataatctttaaaataagaaatattatcagagacaaaaggacatgttataataataaaatggtaatacattcagaaaatataacaattataaatctctatgcaccaaataatagagcttcaaaacacataaagcaaaatttgacagaattaaaaggagatgtaaacaatttaacaataatagttgaagatttcaccctcaataattgatacaacaaatagaaagaaaaacaagaagcatatggaagacctgaacaacactaagacctgaacaacactatcaatcaatttaaccaatatttatagaacaaacaactcaataaatgcagaatacatattattttcaagtgcacatggaacattctccaggataaatcatatattgtatccataaacaaatctcaacaaattttcaaagtttgaaatcatctaaagtttgttctctgatcacaacagaattaaattaggtttagggatccacaacagtaagaattctgagtaaaactcaaatatttggaaattatacaacacacttttaaatagcccatgagtcaaagaagaaatcacaagggaaattaaaatatactttgaactaaatgataatgaaaacacagcatagaaaatgtatggattgcattaaataagcacttagaaggaaaattttagctctaaatgtctatatcagaaaagaacaaaagtaatctaaaggtaatcagtaatctaaacttcctccttaagaaactataagcaaaaggagagaaaaaatattagagcagaaatcagtggatcccataaagagaatcagtgaaaccaaaagttggttctttgaaaatattaagaaaattggcaaattctcagcaagtctgacaaagaaaagaaaatagaagatacagattgttaaaatcagaaattaaagaatggacgttattaccaacactgtgggaattaaaaggattatatgaaaatattatgaataactttataccaacaaattagacaacttagatgaaatgagaacattccttgaaaaatgtaaattacaaacactaagaaatagaaaatatggatagattagaagtgaagaaattgaacacttatgttcatagcagcattattcccaatagccataaggtagaagcaacccaagcattcattgacaagtgaatgaattaacaaatgtggtgtacacatgtaatggaatattgttcaaccttgaaaaagaaggaaattctgacacacgctaccacataaataaactctgaacttacttcagtcacaaaaaagacaaacacagctgggtgcggtggctcgcacctgtaatcccagcatttggggaggccgaggaagatggataacttgaggtcaggggttcaagaccagcctggtcaacatggtgaaactctgtctgtacaaaaaaattagctgggcgtggtggtgtgtacatataatcccagctatttgggtggcagaggcatgagaatcacttgaacgcagaaggcagaggttgtagtgagtcaagattgtgccattgcactccagcctgcatgacagaggggtactctgcctcaaaaacaaaagacaaacgctatatgattccacttgtatgaggtgcctagattagtcaaatttatagacacagaaagtagaatggtggttgcgggaggaggggagaatggggagatgtttagtggtatagagtttcagtttgatgaaaatagttctggagattggttgcacaagtttgactgtacttaacactactgaactgtacacttaaaaatgactcagatggtaaattttatgttatgcagttttaccataatttttttaaaaagaagcttccttggagaacacaagatttcaacacatcattacacctgtataaactcaatgcattccaaaacattataaaaagaagaattagcaatttaaaaagtctgagtaaacctcaaatatttgaatttaaaagaaattgaattagcaattaaaaaatatttccagagagaatagtccagaaccagatgattttaccggtaaattcaatcaaatatttaaagaaataataccaatccttcaaatactttttccaaaaatagagtggggagggaacacttctgaactcacttgatgaagtcactattaccctgttaccaaaaccagacaatgacctcactggaaaagaaaactacagaccaatttccttcatgaacatagatacaaacattctcaacaaaatattagaaatttgaatttagcaatatataaataggattatacactacgaccaagtaagatatatccctgacatgttaggtgatttaatggcatttctgtagagtatatacctagaggtgaaatttctagattatagggtaaaatattttgtaaataatgtcagacttggttccaaagtggttgtacttattaacagtgtatgagagttctcacatgtattaagtaacacttgcattgtcagtcttttaaacttttgactattttttttgaaacacggtcttgttctgtgacccagacagactcactgcagcctcagcctcctgggctcaagtgatcctcctgcctcagtctcctgaagatctgggaccataggcatgtgccaccacatccagctaattaaaaaaaaattttttttgtaaagatggggtctccccgtggttgcccagactggtctctaactcctgggctcaagcaatcctcccacttcatattcccaaattgctgggattactggcatgagccatcgcacccagcctaacttttgcctgtttgataggtataagactatcttactctggttttattttgtatttgcctgaattgtaatacagttgagcaccttcttatgtgtggttagccatttgggtatcttctgtacatgtgtgtaaaatgcctgttagagtttataaatagtgattatatataagattttattgagtgtttactacatgccaggcactaattactagataaagattcattttatcatcacaataaagctaagtagtatgtactattattatctacattaacaacttttttctgcttctattgtgatgaagacaatatgattttcctcttttaacctattaatgtggtgaattacttgcttttcattatgttacatcaaccttaaaatcaaaggataaattctacttgttcatgagctattgtccttcctgtatattgtgaattcaatttgttaatattttgtttaaatttttaaaaatctaggttaatgaataggattaacctatattcttctcttacactgtttttgttaggttttgatatcattattattattattattactgtttttgaggcagagtctcacttggtagtccaagctggactacagtggtagtgcgatcttggctcactgcaacctctgcctcccaggtgcaagcgattctcccgtctcagcctcccgagtagctgggattacaggtgtccaccaccaagcccagataatttttgtattttcagtagagacagggtttcgccatattggccagactggtctcgaactcctgacctcaagtgatctgcctgctttgactcccaaagtgctgggattacaggtgtgagccaccgctcctggcatcattatgatttttaatcctgaatatttatcattattccattacagtagtcccaccttattcacaggacatacttttgaagacacccagtggatgactggaactgctaatagtgccaaaccctatcaatactatgttttttgctatatatgcttacctatgatagagtttaatttataaattaagcacaataagagatgaacaacaatagctaataataaaatagaacaattataacaacatacggtaatgaaagttatgtgagtgtggtctctctcagaatatcttattgtactatactcatctattttcttcaatttttttttaactcaatggttcttttagagacatatacttgcctattttcagatcatggttgaccctgggtaattgaaacgcaggaaagtgaaacctgggataaggagggactgctgaaatttcccctactcatttggaagtaacacacgctagttctataatgtgtagttgttaccttatattatggattgaattgtttccctccaaaagatacactgaagacttaacctcccacctccactcggtaaccttattttgaaatagggtcttgcagatgtaatcaaattaagatgaggtcatcagggtgcaacctaatccaatatggctggcgtcctagtaagaggagatggcagtgacatatggggaagatagcccagtgaagacagagtcagagattggagtaatactgccacaagccaaggaatgcctgagactactagaggctagaaaaagcaaagagggcttcttcccaagagccttcagagagaacatagccctgccaacaccttgattttggacttctagcctctgatactatgaaagaatatatttctgttgtttaagtcccccagtttgtggtactctgttatggcaggggtaggaaactaatcctagaaattccaacctccataattagtgtaccaaagtttacaagtgatcagaatgttattcccttcctggacaaacgtggaacacagggaaaccacaaagaagaaccttttattatttctgtatttcccttcttcaaactcatatgcttttgttgtccagtactttaatcaatccccccttttccccactagaaattctcattgctattttatacagtcgatgcttattttgtttacccacattacctacttgctttgttccacaaagtttgatgcatctcagatcttctttccggtgtcattgtcttcctgcctaggtacagcaagtgattttctgtagtgagaatctgctgacaacaaattctgtcaggtttagtttcactttcactgggtgtagaattctatgtggcaacgattttattttggtacacttaagacaccatttcactatcttctctctaccattactgctgctgagagaagagctagctcttcgttggaatcattctaattgccattctttaaaaagttacttatcaggctgggcgcggtggctcatgcctctaatctgtgtgtcaggaattggtgggttcttggtctcactgacttcaggaatgaagccacggaccctcgccgtgagtgttacagttcttaaagacagcgctttccttcagatgttcggatgtgttcggagtttcttccttctggtgggttcctggtctcactagctcaggagtgaaactgcagacctttgcggtgagtgttacagctcataaaggcagtgtggacccaaagcgtgaacagcagcaagattcactgggaaaagtgaaagaacaacacttccacagtgtggaagtggactccagacccttgccactgctggcttgggcagcttgcttttattctcttatctggcaccacccacatcctgctgattggtccattttacagagagccgattggtctgttttgcagagagctgaatggtctgttttgacagggtgctgattggtgggtttacaatccctgagctagatacaaaagttctccatgtccccccactagattagctagatactgagtgtccattggtgtatttacatacaaaccctgagctagacacagagtgctgattggtgcatttacaaaccttgagctagatacagagtgccgattggtgcattcacaatcccttagctagacataaagattctccaagtccccaccagattaactagatacagagtgccgattggtgcattcataaaccctgagctagacacagggtgctgattggcgtgtttacaaaccttgagctagatacagagtgctgattggtgtatttacaatcccttagctagacataaaggttctccaagtccccaccagactcaggaacccagctggcttcactcagtggatcccgcaccagggccacaggtggagctgcctgccagtcccatgcgccctgcacccgcactcctcagcccttaggcggtcgatgggactgggtgccgtggagcagggagcggtgctcctccaggaggctggggctgcgcaggagcccatggcaggtggggggaggctcatgcatggcaggctgcaggtcccgagccctgccctgcgggggcagctaaggccaggtgagaaatcaagcacagcagctgctggcccaggtgctaagcccctcactgcccagggcttgcaggcgggcccgccgctctgagtgcggggcccgccgagcccacgcccacccggaactcacgctggcccgcaagcgccgcgtgcagctccggttcctgcccgcgcctctccctccacacctctccgcaagctgatggagccggctccggccttggccagcccagaaaggggctcctacagagcagcagcgagctgaagggctcctcaagcgcggccagagtgggtgccaaggtcgaggaggcgccgagagcgagcgagggctgcaagggctgccagcatgctgtcacctctcaccagcactttgggaggcggaggcgggaggatcacgaggtcaggagatcaaggccatcctggctaacagggtgaaaccccgtctctactaaaaatacaaaaaaattagccggacgtggtggcgggcgcctgcagtcccagctactcggagggagaatggcgtgaacctgggaggcggagcttgcagtgagccgagattgcgcgactacactccagcctgcgtgacagagcgagactccgtctcacacacacacaaaaaagtagcttatcttttttccctctggctgttttaaatatttttctctttacttttgtttttctgcaattttactatagtgcatctagttgcagattttattttacttgcttggggttctctggatctcctcaatttatagatttaacatgttccttcgattctggaaaattctcagccattttctctccaaacatttcctgcacctcatcttctctttcctctcctcccaaggacacaatgttagatttctcactatatcctccttgtgtcttactctcgtttttatttttccttctccatgtttcggttggatagtttaatttatctttccattcattagttctctcttatccaatctgctgttgaatccagtcactgaattgttaacattattttagtctttatttataaaatttttttttcaaatctggtatgacaaattttatagtttttctgtttcctgcagatattgtagagtttgtcatttacttctttacacatggttaactatggtgatatttcagtctgtatgatactttcaatacaggagtggagtgcagatgtttctgccttctgttggttctgtggattctcattgaaatcctagcttaatttgaggagg

SEQ ID NO: 23 - DNA, 40001 bp, Homo sapiens
ctcctctaacccagctatttttcaagatgttcataggtcagttaatggtatcactaccttgcaaaccatctagtctcacagtttaaagtggtctgtaaacttgagttgaggacatttaagaaaggaatctcctcatttaatatgcaaaaaggcatacgtgcattttttttttcaggaatgaatgtttttaacttcctttagattttcaaaagggtgtacaactaaagaattttgatttggagtcaattctgtgtattcctctctccttccttttacttgattgttaaatccttttaactttgccaccttgatattctatgtattcctattgtcattactagtatttgatttcattgcctttgtattattctcctaatcattcttgccaatttaatcttcctcaagctcatatttgaacatttgtttaaccaatcatttagtgtgcagtgctaattgctgagaatatcaagatgggtagaatttaatgtcctcagtctgttctcaattttgggaggaaaacagatataaagatttttctaaaagcatgatatgtgcaagaataagttacaaaatgtacacactgctatggcaataatccgaagaggatctgactcattcctagggaatcaaaaacagagtggcactggatgtgacacttgaggtgggtccaggaggatgaataggaactttgcaggcacaaaagattgtggaaggaccatttatggtgatggaatagtatggttagaagcaagaagtcaaagtgcaggttgagcttggggaggtttgcataattcctgtgagacacaaaaattcacgaggtgtgaatggcagtagaataggtcacctcaaaatatgccactttggcataaagattactttaagctcaaggtaccttaaaaaaaaaaaaacagcaggtgcaagaagggttttcctggcagaggacaaaggcagagaggcatgttacctctagggaagatagttgtcctttgtcctggactataaagagaactattgagggactgaaaacattgaactaatcctctttttaagtcactcttgaaacagagaggagaatgacttggaggaagaagagaatgggtactctgtggatggggcagaaagatgcagagggggccaggcatggtggctgacacctgtaatcccaacactttgggaggccaaggagggtggattgcttgaggccaggagttcgagatgaggctggccaacatggtaaaaccctgtctctactaaaaatacaaaaattagctgggcgtggtggtctgtgcctgtaatcccagttgctggggaggctgaggcaggcaaatcacttgaacatgggaggtggaggttgcagtgagacgagatcgtatcactgcactccagtctggacaacagagtgatactctatctaaaaaaaaaaaaaaaaaaaaaatatgcagggagagtaaggtggcacactccacaacttcacaataagacttgaccaagcgattgtgaaatgtcacagaaaacaggaaataaaactctcatatggaagatgtcctccctgtaccagaaggaaagtaacattgttatcatcaaagtcagaaagttgagatcaaaagaattctgtacaaacagaccttatgaatatatatatatatatatattttttttttttttcctggtggagttacccaaccttcatgggtcatttgtagtcctgcctggattgagctgttataatttcccattgaccttaatcatagggcatagtaataccaagagacaccctaatggatctcttgtattccatgcatactctttctcacctctgtaatggaataatagactgatttcaccttgatagtctgggtcagtcaccccagccaacactgtaactcccttcttagcctgttgacttaaaggtaggaggagcccaaagtgtccaggtggcaatcttaacttccactttaatgaaatcattgttgtgtctcctggtggcagcgtacctccctctggaactaagacctctaggccagaagaacataatgttgcaggaacaggaagcaaaaaatttgctagtggatcactaggggtgatggtgaggggtgccacttccaccccttgattcctggacctgtgaatcctggctttgggagaaacagtaacatattggacactgattcagagcatacccggccttctggagaactttgtcccagccctgcaaagtattgtcatctagttggcacagtaattgtgacttcaataggccattccaccattatatcaatccagcttcttcaggatgatggggaacatggtaagaccagtgaatttcataagcatgagcccactgccacacttctttacccctaaagtgagtcccttggtcagaggcaatgctgtgtggaataccatgatggtggatgaggcattccatgagtccatggatggtagtcttgacagaagtattgcatgcaggataggcaaacccatacccagagtaagtgtctaccagtgaggacaaacctctgccctttgcatgacggaagaggtccaatataatcaacctgccaccaggtagctggctgatcaccccaagaaatggtgccatatcaagggctcagtgttggcctctgctgctggcaaattgggcactcagcagtggccatagccaggttagctttggtgagtggaagtccatgttgctgagcccatgcgaaacctccatccctgccaccatggccactttgttcatgggcccactgggcgatgaaaggggttgctggggaaagaggctgagtggtgtccacagaatgggtcatcctatccacttgattattaaactcctcctccactgaggtcacccattggtgagcattcacacagaatacaaatatcttcacagtttctgacccctcagagaggtccatccacatacctcttccccaaatttctttgtcaccaattttccaatcatgcttctttcaagttcctgaccatccagccaaaccattggctatagcccatgaatcagtatataatttcacatctagccatttctccttccatgtgaagtgcacaagcaggtgcactgctcgaagttctgcccactgggaagattttccttcactgtcgttcttcacggatgtcctagaaaggggctatagtgctgcaggtccactttcgggtggtgcctgcatattgtgcagaaccatctgtgaaccaggtcctagtcttctcttcgtctgtcaactgatcatagagaactccccatgaggccatcagtgcaggctgggggagaaaaggcagggtggcaggagtggagatcatggacatttgagccacttcctcatgtaacttacttgtgccttcaggaactgcttgagccttatcacgtgtataccacttccatttcatgatggaatgctgctgtgtgtgacccactttatggctagatgggtcagaaagcacccagttcatgataggcagttcaggtcacatggtgacctgatgacccatagtcaaacgttcagtttcggccaaagcccattaattacctgacctccataagcccctactttaactggaggaccacagtgacattttggatcccctggaatcaacatcagctcagagccagtgacaagtagtctctgaaatgtctgatcatttccctttccccagtgcacagttaccctggtaaaaagtcagctgtctccttggggaaggatgggagaaaaattcactgaataaattgtcggtaatgtagtggggtccttctccaaggggatgcggctccccttcattcaaggggttctaagtctgtaaactggctcaagtctggaaattgattgaggggctgtgactctctgtttttataattcaaattagtcttttgtccattcgacctaaaagttttctgtttgtgtactttaaataggaatgcagtaggcttcctgtcaatttcgcttctaggaacaccatgattaattagccaatgccagagttctacatgagtcagactattctgatttctgctttgcctctgctgtccattacaggagctacatccaccttgcctttgacagtcgagtgctgctacttggcccctgccaccttgtgatctgatcattcccattgtatttaaattttgtagttcccactattagatctgacatacagagaagagcgattacaggactcttcaaagatgcaggtgccgccctcgcaaatctatttcacaaggcattagttaagggtatatcttctggatcctcccagctgggatgagaggtctaaagtgactaatctactccactgtcccaatctccctaagcctttggatcccttcttctccattaaaccaagagagatcaggcatttccagctcgctcacagtgggccatattttaatccatatttcagctaaccaagcaaataaactattagaaccttttttaactccctgagctgcaacattagatgcagagtccctacttagtgggcccaaatcaataaattcagcctgatcctactctatgttccttccaacattatctcatacccttaatatccattcccatgcctgttctccagatggctgtttatattaattagaaaactcacagtttttttcaagtgtagtacacctccttatgggtcacactctcaacctcacctctaggggcccgccaggactttcatctagttgtaagtctagaagcaaacagaggtgatgagtgtgacttctgaggaaaatcagcattaccttgcctggcaactgcctcaggggaggccatcactgttgcctcaggcagcacagggtttatctcctcagacaaaggtggaaaggctgatggcagcgtgggtccaggaggggatgttgccactactggggattaggaagctgttccttctggcaaaaaagttcatcagagtttacaaactcagtgtcctcagcttcatcagggtcctcccacacgtccccattccaagttgcagggtcccattcttttccaatcaatgccctctctttaacagtagacacctggcgaggctgtgcacgcatctttcactgcaggtcagccactcacataataagagcgcgtgtctgtttgtccacaatttcagctctttctctacaggaaacaagactctcactcagggaaatcttagcagatttgaggctcagtatctgcttctgaagccaggacagagaatccctgatttcatcattttctgtaatcactttgtccactgagtttaggagcaaccaaccagcttcattatgttccttggttctccacatatggtcaaagttactatgtatagagtcactaaactccttgcctctcatgagtggtgaattaggagcatcaaatgcatttattttgcataactctctaaagagctcatgccaaggactatcagtgttatctatactattggaagtacagtccctagcattgtggggtctaatcatattaagcagccaactccagaaaccccaaaaccaactaaagaactccatccttaatattctgttcctctagaaccattcctggtaccaaaatctgtattagtcagggttcttttagagggacagaactaataggatatgtttatgtgtgtgtgtgtgatgtacacatacatatatatatatatgagtttattaagtattaacttacactatcacaatatcccacaataggctgtctgcaagctgaggagcaaagagagccagtctgagtcccaaaactgaagaacttggagtttgacgtttgagggcaggtagcgtccagcaggggagaaagatgtaggctgggaggctaggcccattgtctctttttcacattttttctgcctgctttatattcgctggaagctaaggcaaattaagggtggatctgccttccccagaccattgactcaaatgttaatatttttggcaacaccctcacagacacacccaggattaatactttgtatcctttaatccaatcaagttgacactcagtagtaaccatcacacaaggattggtgatgatgctctttgttcaggcagtaccaggaggcaaacaagagacagacacctgagcacaactcaacagacctgacaatagaaccatctcagaaagtcagcttctaagaaaccaattctagttatatattttcccatctaaacctaattgacaagagaccagggaagacagaatttgcaggaccaagtcttggaagaaaaagaaaacctagatatgtgagcctggtatttggactctctttccccttagaggaacccgacaaagtggctggtggctgaggagctccacgaggtgtcctgtgagctgtagggacaaaaaaaagtggaggaaaaaaaagacaaagctagaaaaggctagaaaaggttccctggtagacacttcaggcattcagcggggatcctgaagggcatcatctcaggaataaatgtgaatgagaacagacttcacaagaactgaggcctagctttggattattttaatcccagattgcattaagatgacctacttctggccaaacttgctgccagaagcaaatgttaatcctctgtggaggaagagaacattttccaaagcctcaaattgctcttataatttttcacatacaaatgtttagaggtgagttaagaaataattcggcctacaaaaataatatataattgacccctaactggaaagagccatgggagatataaatattggaatttttaaatgtgtattttaatgagcattttagttctcataaaactaaacaaattaaattaagaagttaatgtttaagaaattaaataacaaaatggaaaagtttggcagagaagtgacaactataaaaattaatcaaatggaaattctaggactgaaaaaatacaattacaaagcaagaactgatgcagctgaaaagaaaataagtacattggaatacaggccagaacaaaatatgcagactgaagcagggaaagacaaaaagatctaagagacatatgaaacagaataaaaaggtctagcatacatgtaactggattccacagacagaagaaaaagaatatagcagaagaaatacttgaagagatgatctctgagagttttccaaaatgacaaaagttatcaagccacagatttaagaaagataaatatcaagaagtcctaagcagaattcatgataataaaaccatagacttaaagacttaatgttatcaaaataccaatttttctgcggaataacttatagatccaatgcaagagcagagaggaaaatatgtttttttttcaatcaatggtgctggatcaattaaatatatgtttcgaaaaatacatattgaactcttccttacaccatacataaaaagaaatttcaggtggatcatatgtctaaatataaaatgtaaaacaaacaaaagttttgaagagacatagagaatgtctcactactttggaggaagcaaagattttctaaatagaaaaaagaaaagcactagtcgtaaagggaaacattgacaaattggactatattaaaattagggacttcaatttattggaagatatcattagaagaatggatggagatagtggtaacccatgtaaccaacagcagagggcctgaagaaaaggctcgagtcaaagagatatcaagagcttctatcagcagataactcaaaagaaaaatggacaagagacttgaagagacactcatacaaaaaagatgttatgagctgaatggtatccccccaggttcatatgttgaagccccaactccagtacctcagaatgtgactgcatttggagatagtgcctttaaagaagtaattaagttaaaatgaggtcagggggtgggccccaattcaatatgactgctgtccttataaaggggagattaggacacacacaaacgggggaagaccgtgtgaagacacagggagaacacagtcctctacatgtcaaggagagagccctcagaagaaagcaaacctgccaacaccttaatcttctagacttctagcctccacaattgtgagaaagtaaatttctgatgtttgagtcacccagtcggtggtaccttgttatgacaaccctagcacacgaatacagagggtattcaaaaggtcaataaatgcatgagatggtgctcaaccttattagtcatctgggaaatgcaaattaaaaccacaataggataccacttctcacccaccaaaattgctaaaattaaaacatctgacaatgccagatatgttaactattactctaattgtcaactcagttaatgtatatttgaagcgttactccaggcaccatactaaagaaatgggccacaaagataaacaagacagacactgtctctacccctccttgagcttatagtccaggaggaaagacagacgaccaaactagttaatggaaataatacatgcgaagggttatggttgtgaaagtgtaaaggcctttggagacacaaagcaagaacatctagcctaatatggaggcaaagtcagtggcaattaagaataaaaggtcagcatttcatggatctcctgacgagaactggattgagatatatgggctccacaaacaggcggataactagtgctcctgcagaaaggtggttggttttcaaatgttcaacattcattcaaagatgaggccaaatctgtttggaggagagcagagaaggaccacaggttctgcctctgcctctcccctactgtttacagcaatcctgttctggttccaactcaaactcgtcaaaacagaaggctacaatcaaggctggctccatgggcatgtgacctgtgaagctgcacacgctccaagagtagaatagctctgtgtttggttaaatgctttgttatcactttttttaaattcttaataattgttgactgatgggccccacattctcattttgcactaggaccctcatattaggggcctagtgcaaactaactactgtgctactactactgctactactactgtagtgacttcaactaactacactcgtaatacttagcagattagcatgcaccttgggagtctgatctgaaaagggctgttggaaacgcagcctctctgggcctattccagaacagctgaatcagaatctgcattttattttttattttatttaattaattaattaacttttttttttgagacagggtctcgctctgccacccaggctggagtgcagcggtgcgatctcagctcacggcaacccccacctcccaggttcaagcgattctcctgtctcagcctacctagtagctgggactacaagcgcacaccagcacgctcggctcatttttttatttttagaagagacaggatttcaccatattggcaaggctggtctcaaactcctgagctcaagtaatgtgcccaccttggcatcccaaagtgctaggaaaaacctgcattttaaaagctcccctggcaatttgaaggcacattcaagtttgagaagtgttgactgagaacatctcctccctaatacgcgcaagagtggagctagttccccatcacccctctggtgagcatgtgacttgacctggccaatgagaataccatatttcctgtcaacgatgattatttagttcatggataagcatgtgactccagttatgccaaacaatctaaacattggaatttgtatgggaactactgagctgaggctgtcttgtttttccaggactgtaacagtaaggatgacctgagtctggaggtatatgtgtaagcctagaaatgatgccaacattgcagaaagacaagtcaagaaatgggaagaaacagtcttgatgctgaagaggttaaggatataatgctccaaaatgctcagcttgtactttatttctagctgaaagcacttgagaagcagcagctgcagaaagcaccatctgaactgccctttcttacctatagcaagccataaaaattcctgtgagaaagctgccttcaagccaggcgtgaaggtgcacacctgtagtctcagctactcaggaggctgaggcaggaggattgcttgagcccaggagttcaaggctgcagtgagctatgatcacaccactccactgcagcctgagtaacaaagtgacacctcatctcttaaaaaaagaaaggaaggtacaggtataaaaaagaatgagctcatgtcctttgcagggacatggatgaagctggaagccatcattctcagcaaactaacacaagaacagaaaaccaaacaccgcatgttctcactcaaaagtgggaggtaaacaatgagaacacatggacatagggaggggaacatcccctgacaggggcctgtcagggggcagaggacaaggggagggagaacattaggacaaatagctaatgcatgtggggcttaaaacctagatgacgggttgataggtgcagcaaaccaccatggcacgtgtatacctatgcaacaaacgtgcacattctgcacatgtatcccagaacttaaaggaaagaaagaaagagagaaagagaaagagagaaagagagaaagagagaaagagagaaagaaagaaagaaagaaagaaagaaagaaagaaagaaagaaagaaagaaagaaaaagctgccttgcctgttccagcatgagaagataacccttattagccatgactgagaagtgatgctgcaatggatccgaataaataagcttactaaaataatcctcctctttcactagccttacagccctccatatatctcttagtgattaccctagaatttactgcccctagcccagacccagtcttgtcatttcttcacaaaatgtatcattctttgcctgaaaggtataaaagctttctgctttggccatttctttgggtcttccctctcttgtgaggatccccatgtatatgtaaaattaataaaacctgtatgcttttgtcctattaatctatcttgtatcaatttggttgagatggagcagggaacccttttaggggcctcctggggacttccttcaaacatggaaataaaggaaagtcttgagtaccttcaagggaaattccaggcacccagctagccttgagaagtacatgagcaacctgataatcaagaaggtaataacagcttaaaacaatagccaggaaagttaaagtcccaaaatgtttggctccatgtagaaactaaagataacatctccggccccaagttgtttttcagaaacctggaccgctacccaatggaaaatgtcatctgctggcacatagacctcagataagggagcactgaggactgaaccctgatcaccatcctgtgtcctaaatttcttcctgagggtcctgaaggaagtcctgcccacaggccagagctcaacatttcttcctgctgatgccaagtttttagacaaagctttgcttccctaacaaatcacaaatcagagaatctttttgaatccacctatgacctgtgggccaccgccaccccgcaccccagtttgagaggtcctgcctttttaggtcaaattaatatataacctccatgtactgatttatgattttgcctggaacctttgacttcccatcttttttaaaaaaatgttatttatttatttattttttaaatagagacacattcttgccatgttgcccaggctggtcttgaactcctggggtcagacaatcctcccacctcagcctcccaaagttctgggattacaggcatgagccactgtgcccagcgtgcctccccatctttaaaaactcttacctataagccattagggagttctgatcttaagcataagctgccaattctccttgcttggtgccctgcaataaatgcctcattttctccagctgcaaatcctgatgtcagtgtttggctttgctgtgccaccgaagtttggttcagtaacagctcctagacccagcagaagattttacttaaaaacaaagatgggcaagtcacggtggctcacgtctgtaatcccagcactttgggaggccgtggcaggcagatcacttgaagtcaagagttcgagagcagcctggccaacatggtaaaaccctgtctccgctaaaaatacaaaaattagctgggcgtaatggtgtgtgcctgtaatcccagctactcaggaggctgaggcaggagaattgcttgaacccgggagatggaggagagccgtgagccgagatcgcgccactgcactctagcctgggcaacagagccagacctcatctcaaaaaaacaaaacaaaacaatcaacaaaaacaaaaaatcaaaaacccaaaaccccaaagatgggtagagggggtctttaggctcccttacaatgccattgcttgagctcctggatcaaggtgtgcttgaagttaaaaatctatccttggacctttcagtttcatttaagttcattggagtcaggttttctgttttttggtactaaaagagccctgatggataaacgccttctgttcacaattgcctaagatgactctcagagatagagagagatgttttgctgtaagggtgtgcacacatcaatagatgaactccttgctcaaattatccagtttggttgttaagttgcagaaattcacaggataattaccaaatttccactttgttttgctttggatactagtccttgattaaaaatattttctatctgtatgtgtttttctgcggttttaatacatagaattcaattgtaggtactcatggaggaccaatcgattcctatgtgtaataacatgtttccttctggaatgtaactttcctaggccattcactgagccaacaatgctaagaataaatattcacataaggaatatatgcctaaaagcatagcgctaacaaagtcctccctccctcatatgtccagtttctcctttaattgtagcttatgtgccattatctcaaggaaatgattaaccaactttatctttaataccacatcagagtcctctttccctcaaagcattccaaaccatgttttatttccctctgactatactgtaggtagctgaatgccctgggtaaagaattttctcagcacgtgcttgttgaattctgttaaatctatacacactcacaagcagggtaaatgctataaagtattttaaggttacaaatctaacttaattataaatcattagcgctggaagacaccaagagtcgttagctgaacccacccttaccgtagatcaatctctcactctctcaagaagaaaaaacatagatgtaactacagcccactctactccttccttcttcctccctttctgcccagaggtaagctctaaggtgatgttggcatatatcaatctgatgtatgtttttgtacttttatgatgtatgttagtgcctgaaaatttacataaattgaatcatatttagtgtattttcagtgtgctttttttcactcgatgttacattttttagtttacccacatggatcaacatggctgtgccctaggacacacctgcacgtgagcacacggaacaatgaatacagccgttcactgcagcactgctcataacagggaagaaatagaaaccactcagtttagaggaatgagtgagctatttgtttctataatggaatgccaatccacagttaaaacaaataacttttgtattttacagaagaggggcgtggtccagagaaattctgtgaaatgacaaatgtcactcagatggataatgggaaatctgaacccaaaaccaggactcctgagtctaagcctagcggtctttctaatgaaccttatcttttgtaataatttaaacttccagaaaaactgtgaaaacaatacatacaaagaattctcctatactttttaccagattagctatttttaactttttgccacattttcttttcttttcttttaaatagagacaaggtcttgctatattgaccaggctggtctcgaactcctggatcgcttgaggtgatcctcccatcttggcctcccaaagtgctgggattacaggcatgagccaccgcgcctgaccacgtttgttttattctctctctcactctctctgtttagagatataattttttccctaaaccatccaagagagaggttgcttgaatatataatggcccttttgctgtaatatttcactgtgttttcatattaataaaaatgttttaaaatatccacagcagagatatcaaatgcagaaaatttcacattgatacagaatttctttttataatctataatccatattaaaattttgttgaatgcctcaatagtatccctgagagagaatctcccatcacattcaccctcagcataggagtcagtcctggattatgcattgtgttcagtggtcaaacttagtttttatttgtttatttatttgcaccaaacacatttgcatttattttcttttttaaaaaagcaaatgacggctgggcgcggtggctcacgcctgtaatcccagcactttgggaggccgaggtaggcggatcacgaggtcaggagatcaagaccatcctggctaacacagtgaaaccccgtctctactaaaaatacaaaaaattagccgggcgaggtggcgggtgcctgcagtcccagctactagggaggctgaggcaggagaatggcgtgaacccaggggacggagcctgcagtgagcctagatcgcgccactgcactccagcctgggcgacagcgagactccatctcaggaaaaaaaaaaaaagcaaatgacaaagacccactttacctgctttgcttttttaaacctaagcttaacatcacatatttaaacaattgtcaagacttactgagttgacaggattcaggctcagctagaaaacacccttaatttatattaaaccagaaatgtattaccattaatgcattaatatcttttactactacatactgaaaaacaaaatgaatttagttctgtagaagattcgccctggcaatggtgacctcacagcaggccaacactatgtggctcacatttcagacacaatggaaaagcagatccatgctggtgttagtgcacagtcttgtcctacactaaagagtcaaggctcaccttggagtacatttaataaaagggcaaaaagcatacagacatttacaataatatatatatttttgagacagagtcttgccctgtcacctaggctggagtgcaatggtgtgatcttggctcactgcaacctccacctcccgggttcaagcaattcttctgcctcagcctcccaagtagccggtattataggtgcctgccaccacacctggctacttttctgtatttttagtagagatggagtttcaccatgttggccaggctggttttgaactcctgacctcacttgatccacccgcctcagcctcccgaagtgctgggattacaggtgtaagccactgcacctggcctacaataattttgaagacaaaaagaaaaaatggtcctattatgggtcccaacaataaactcaaaagcctatgacaaatagaggttccgattagctgtttataaatactttaggtactattattctgaaaggcaagttcccttgaaatctacaaaaaaaaagtttctgttaatcctcagatggttcttgttatagtttaacatttctgttaagtgggcgccttgaattacttgttatccaagtgcagcagctgctccttaacacttattgttaaagacattaactggctgtcttcttcaacttctactctttcttgaccattcttgataattctctttatcgtgatttttctgccattaacctttttagtagaagtgttatcgatttgaagttgcccatcccactaccaacatatgatgtggaagaaaatgaagtgaggcccccgtgaccgagtgacccaaatgaagtattaataaatcctatatcaaaataagaaaatccacttctaaaagatggaaatccactgaatgtggagaaaaactaccccgacccttggtttctgcttccacggggacccctttgattctgaaacaagtcctcaaaagagttcttcaaagaagtcaaatgaaaatgggtcccttccaccaaaaaattccctgaagacatcatctgggttacagaatgtgaagccaaactcaaaaggactgtcaaaatgacttccacctcctcctccaccatttaatccttctttgccatatttgtcatagatgtcccgttttttagcatctgacaacacctcacacacctcagctacttgtttgaattttctctctgctttttattctcaggattttcatctgggtgccacttcagtgccagtttctggtgtgcctttttaatatcctcgggtgaggcctctctccacactcctagaatttcatagtaatccaccatgattttgtttgtttgtttgagacagagtctcgttctgtcacccaggctggagtgcagtagcaccatcttggctcgctgcaacctcgcctctggggttcaagacattctcctgtctcagcctcctgagtagctgggattacagacttgtgtcactatgcccagctaatttttatatttttggtagagacggggtttcagcacgttggccaggctggtcttgaactcctgacctcaggtgttccacttggctcgacctcccaaaatgctgggattataggcatgagccgctgtgcccagcctaacccatcatgctttaagagattgctggaacaggatggaggcgactgacggcaggcgggaggcaggggcagtggccaggatctcctcctggctctggcactgctgcgctggtggtggtgactacttgtgctttcctctcaagcctagtttttttttttttttaattttttttttattttttattttttaaattttttaaattttactttaagttctggcatacatgtgtagaacgtgcaagtttgttacataggtatacatgtgccatggtggtttgcagcacctatcaacctatgctctccctccccttgcccctgaccccctgacaggcctcggtgtgtggtgttcccattcctgtgtccatgtgttctcattgttcaactcccacttatgagtgagaacacgcagtgtttggttttctgttcctgcattagcttgctgagaatgatggcttccagcttcatccatgtccctgcaaaggacattagctcattctttttaatggctgcatggtattgcatggtgtatatgtgccacattttctttatccggtctattattgatgggtatttgtgttggttccaagtctttgctattgtaaatagggttgcaataaacatacatgtgcatgtgtctttatagtagaatgatttataatcctttaggtatatacccagtaatcggattgctgggtcaaatggtatttctggttctagatccttgaggaattgctacactgtcttccacaattgttgaactagtttacactcccaccaacagtgtaaaagcattcctatttctccactgcctcaccagcatctcttgtttcctgactttttaatgatcaccattctaactggcatgagatggtatctcattgtggttttgatttgcatttctctaatgaccagtgatgataagcttcttttcatatgtttgttggctgcataaatgtcttcttttgagaagtgtctgttgatatccttcacccactttttgatggggttgtttttttcttgtaaatttgttgaagttccttgtagattctggatattagatctttgtcagacggttagcttgcaaaaattttctcccattctgtaggttgcctgttcactctgatgatagtgtcttttgctatgcagaagctctttagtttgattagattccatttgtcaatgtgggcttttgtcgccattgcttttggtgttttcgtcatgaagtctttgcacaggcctatgtcctgaatgatattgcctaggttttcttctagggtttttatgcttttgagttttacatttaagtctttaatccatcttgagttaatttttgtataaggtgtaaggaagggatccagtttcagttttctgcatatggctagccagtcttcccagcatcatttattaaacagggagtcctttccccattgctcctttccccattgctttttttgtcaggtttgtcaaagatcagatgattgtagatgtgtggtgttatttctgaggtctctgttctgttccgttggtctatgtatctgttttggtaccagtaccatgctgttttggttactgtagccttgtagtatagtttgaagtcaggtagcgtgatggctccagctttgttctttttgcttatgattgtcttggctattcaggctcttttttggttccatatgaaatttaaagtagttttttccaattctgtgaagaaagtcactggtagcttgatgggaatagcattgaatctataaattactttgggcagtatggccattttcacgatattgattcttcctatcaatgagcatggaatgtttttccatttgtttgtgtcctctctgatttccctgagcagtggtttgtagttcttgaggaggtccttcatgtcccttgtaaatcgtattcccacgtattttattgtctttgtagcaattgtgaatgggagttcactcatgatttggctctctgcttgtctatcattggtgtataggaatgcttgtgatttttgcacattgattttgtatcctcagagtttgctgaagttgcttatcagtgtaaagaatttttgggctgagatgatggggttttctaaatatacaatcatgtcgtctgcaatcagagacaagttgacttcctttcttcctatttgaataccctttatttctttctcttgcctgattgccctggccagaacttccaatactatgtttaataggagtggagagagagggcatccttgtcttgtgccggtttaaagggaatgattccagcttttgcccactcattatgatattggctatgggtttgtcataaatagctcttatcatcttctcaagcctagtttttaaacaatttattactgctgaatctcagcatgtttcacagatatgtctttcataattcctctattacacacacccgctgaccttaatatactcttgagtacaattgctatattcttggtattgtacacgttatttcttactaccaagaagaagcctctagtctttcatgacaatttaaagacacaagctaaataccagtccccatcccttgaggaattcatagtacagcacagacacatggggtgcgagcgaggtgaatacattcaaaaccagctccaccacttatgacctaagtggtgctgggcaagaaaaagcatctctctgactcagtttcctcagtgtaaaatggtgataataatatctacctcacagcttgtttggaagattaagttaaataatgtgtgggaagagcccaatatgaattcattgcagatacattttctttgtgcactgagatttagtttctgtcaagtttgtgtgttcgtggttatgacacccctaaaggctattcacagcaggagatgtgggagctgacacttaagtcatttcttccccagtttatgacaaggttacctggtttccactcaaacacagataaaggtgctttctcttttacatgctacaccacatcaaacttagtatcgtgcaaaagagttttgcttacacagtcatagaaaaggaaatttgcatcagtttgcttgaacattttggttagccatactttactcacattctgaaactcagtcatgtaattcagaggggtttttctcttcttagatgatttgcagtatatttatccaggaataattgctgagatgcaaagatgacaattataagcatttatacaagtaaaagtattagaattttagttctattttagacttccaaataggatgcacaatgagttgataaggcaatccggtggttcttcacaggtttctaatatttagggtgttttcttcaagctgaattgcatttattgccaattcttccatctgccattgcaaagagggtgatgtagggaggaattgtcaggatagcaagaggtttaactccagtaacaatttattgaaaataacatcaaatatttatttccactgtagtacctacccaatttcagataatttagcgtacaagataaaacaaacaccattagttgttgctaatcattattaaaagaaaataatgtgagttctaagagcctaaaaatacaaagctttttttcttttctttttcttttttctttttttaattttggagagttgtattagctagggctctcaattgaaaatagtagaagcccaactctaagtagctaaggaagaaagaaggctgtattataaagtttctcatgggtcatgagtcatgaatatgattgaacattattaacaattagagcaagggattctaatgcattcagggttctcatttcatctctcctctgtccttttctgtggatctgtttattattcttcttattctgcgtctatgggccatcttcctttcattctggccacatggagaaaaacaagactgacagcttctgaacttgccacctaacactctgtcactggaaggagtctgtctctttcgcaggcctaattgcacaattcctagggaaagcctttgattggcccagcttggatcaggtgcatacttcacaccaatcaactgctgctagctaatcagagtgatactgaagcaacatgtggataggaggaaaagagcaggtcctagaagaggaaaactggcaagacaatagatgaccgctgttacggacagaattgtgtcccccaaaatccatatgttgaagccttaagtcccaatgtgactgtatttggtgatagggccttaagggaagtaactaagattaagtgaggttataaggacggggacctaattcgataggatcaatgtccttatacaaagagaatgagacagcagaaatatttctctctccttctctctgcatgagcctaagggaaggctatatgacatggtaaagaagatggtcatccacaagccagaaagagaggtctcaccagacaccaaccctgccagcaccttaatcttaaattcttagcctccaaaactgtgagaaaataaatttctattgtttaagacaaccagtctgtggtgttttgttatggcagcctgagcagactactacaaccaccataggcatgtactccatccattctctgaaaaaataatttctgattacgtattacatccattaggatcaattcaaatacaaatagcagaatctgcaagaacagtgatattagaacattactctcaggtaaaagaagttaaggaaagtgatccaaggcagctcctcaaaatcatcggagatgtgggcttttctgtcttctgctcaccttactcagcacacaacttctatcttccaggtcaccttattgtctcagataggagctggagctctagatgtcatgctcgcttcccagtcagcaggaaggaggaagagggaggaaaatattctccatttgtctgtccccactctttaataagacagcttggaaatccctctaacagtttctgtgtatatctcattggacagaattcagttacatgaccacacctagctgcaagggaggctagaaatgtatcttttcactgagagaactgctatcatcaatgacataggggttctgttaggaagtaagaatttgagaacggaagttgaacggacaattagcaggctctgccacagttactatgagccagacactgtggtaaatgctgtattagtccattttcacgctgctggtaaagacatacccaagactgggcaatttgcaaaaaaaagagatttaatggacttacagttccatatggctggggaggcctcacagtcatggtggaaggcaaggaggggcaagtcacatcttacatggatgggggccggcaaagagagagagctcatgcagggaaagtcccatttttaaaaccatcagatcttgtgagacttattatcatgagaaccacatgggaaagacctgctccatgattcaattacttcccaccaggttcctcccacaacacatgagaattcaagatgagatttgggtggggacacagccaaatcaatcaaatgccaattacagcttcattcagaaaattagcaggctagataaaaacaaaatttaatagcatttaaaacaataataaataaaattaccccctgtggattatctctagctaactatatcaagtaaaatcatctgtgatttataattgatgtgacacattatgccaaacttcctaccggcagtttatgatgatgatgatgatggtgattaagatatttggctgggcatattggctcatgcctgtaatcctagcactttgggaggccaaggtgggcagattatttgagccctggagttcaaggtcagtctggacaacatgttgaaaccccgtctctacaaaaaattagccaggcctggtggcatgcacctgtagtcccagctgctcggggggtactgaggcaggaggattacccgagcttgggaagtggaggaagtcaaggctgcagtgagccaagatcatgccactgctctccagcctgggcagcagagtgagaccctatctcaaaaaaaaaagacatttgattaatattctctaagttgattgcacctgtttgctcattttctttaacatgctacaccctttgtctgccccattatcagccagagagctatctaattagtgtggtggctaaaaatatctccccccagagaaaggaaggatagtgtttgcccactgaggtgttattaactctgccacatgaatctatctgaagacagggtttcagtcaacagcaaagaagatggttgaaaatgactgtcatttcaatgactccaataactattggagtggtcctagaaaataaaacaaagctgcataaatgaaaataaaaacacataattttacattatgtcgttgctttcttgtcaattatagagtggcagtttagagaaaaacaacaatggtgatgataaaataatggagtattgaggaagagcctcagaaaacacattgaggtctgaaagctctttgccttcgtgaaatactcttttctgtcttgtgagaagtagatggaatgactagattgggccattatctattgttcattcattcagtcaacaaatatttattgaacacctactatgtgccaggcactgttctaagcattaaaggtttatagggaacagagtagacacaatttctgtccttctggatcttacactgtagtgactgacagacaatgaacaagattaatgagtaagatgtgtagtatgttcaattttagatggtggtgagtgttgtgaagaaaggcaaagcagaggagactagaatgcatgggggtggaggtttgtcatttacatggaatggctggggagggctgaataggaggcaacaggaattccgagaggtagcgtgctagtgcacgattcagaagggaacagcaggagcaaagaccctggggtgcttacaaggttcccagtatctggagctgagtgattacaatggaggatcctgggacagaagaggtaaaccaggtggggcctcctaggtcattatagtgactcagactcctgtcgtgtgtgggatggaaagccactgacagatttggagcagacaagtatggttgtagcaggatcatctggctattaagacagacctttgggaggcttttgtaataactcaggcaagagatgactgtagtttgagctaggcggttgagttgaggtggtaagaaatgattcaatttctgaatatattttgaaggtaggatggatagggtttcctgatggagtagatgtgaggaatgaaagaaaaaagtcaaggatggcaccaagatttttgggcaactagaaaaatggcaacactatttactgagatgggacatctgtgagaagaaaaagcttgggtcttaaataccttgatgatagacaaatgaagatgctagtagacagttgaatctggagttgagtcttgagttcaaaatagatgttgggttagcctgttcttataacatgtagatcgtgtttaaagccacaagaatggacaagatcaccaagggagaaaccaaggccttcactgtggggccttcaacgtttaggtggcaaagagactaggagaaaccagagaagtagactgagaatgagtggtcagagtaaggggtcaggggtgtgtggtgttcttggaggaagaaagtgtttcaaggaggagagagtcaactcaaattttctcaagcaaggtgcaccaagatcagtatccctgtcccagaaagtaggacaaggagagaacatgaaactccagtgattgtccaacatcacatacttggcatatagtaaatttgaaattcaaaagcccagattgtggctaggcatggtggctgacacctataatcccagcactttgggagatcaaggaaggaggattgcttgaagctaggaggtcaagaccagcctgggcaacatagcgagataacatctctacaaaaaacaaaaaaattagccaggcatgttttgtgcacctacagtcgtagttattcaggaggctgaggcaagaacatcacttgagccctagagttcgaggatgcagtgagccatgattgcaccactgcactccagcctgggtgacagagcaagaccctgcctctaaaacaaaacaaaacaaaacaacaacaacaaaaaaacccaaaatcccctctgattgtttgaccttaatccaagctcttaaaaggaaaaaataaagtttagtctacctatttgtaatatcagttacatttgtagttccacatgtttttctgatttttttctaactgaagatttctacttcttagtaaaacaaaagcaacaaaatggaaaagacaatgtaagagttttaataagtgcctcaaaaattatcatttcattaaagcgatgaagatgggttgaatctattaatatcatttattgtgtttgcaaagtgcttctgtttttttgttctttgtttttcttacattagaattgcttttcttcattgctctgggcttcagcagcctccctcctgttcttcaaagagttctgcatgggctgcctctattcaatcaaatggaatctccaaagtaacacattgaatgggatgtgcaacgaatactaaaaaaagaatgaatctgcaaatacttagcagctggcagtttcttaaaatcctaatctcttcatttggtgaaacagaagtgatttccaatttcagcaactaagataaaataaatcttctatattgaaccgcaaaataaaataaatgctaaactttgtttaaatgtagataagactgggtgcagtggctcatgcctgtaatctcagcactttgggaggctgaggtaggaggatctcttgagtctaagagtttgagaccgacctgggcaacatggagaaaccccatccctacaaaaaaatatattttaaaaatctagataagaagagatttgcaataagtatcacagcaaccgttatcaaatgaatatcaaattttgcatgtttactatgagatcctgaacactaaaatgaaagatcaggagtatgacaggaatttagggttgtgctatttaatagttggacaaaaacacttctgcactacctaagagtgcatgcttttagagttttctagtcctgtttcctcgcctctttttcactccacttagtccactgacattttctgcctctcctctcaggtacctagtattcctattcttactgtatcaaaattcctccagtgcctacttcatgctaagcactctgccagtgctttcttcttcttctttttttttcttgacacaggatcttgctctgttgcacaggctgaagtgcagtggcccatctcagctcactgcaacctctgcctcccaggctgaagcagtcctcccacctcagcctcctgagtagctgggactataggcacacaccaccacacctggctaattttttgtagagattgggttttgccatgttgcccaggctggtctcaatgtactgagctcaagtgatccactggccttggcctcccacagtgctgggattacaggcatgagccactctgactagcctgccagtgtttccaaatgttatttaatttaatgttctcaacgaatggccagaggaagatattaataggatcttttttaaggaaaaagaaactgaatcctcctggttaagggtttgctggaaaccacatagccagggtctgagaaaggtggattctttttatttatttatttttgagacagagttttgctctgtcgcccaggctggggtgcaatggtgcgatctcggctcactgcaacctccgcctcgccggttcaaatgattctcctgcctcatcctccctagtagctgggattacaggcgtgtgccaccatgcccaactaattttttgtatttttagtagagacagggtttcaccatgttggccagactactctcaaactcctcacctcaggtgatctgcccgcctcagccccgcaaagtactgggattacaggtgtgagctaccgcatccagccagaaaggtagattctaatctgatctgtgtcttctaatgcccactgttctcccattgcttaatatcaccgtatgttaggctgttcttgcattgctataaagaaatatctaaccatccttttcttggggttgcactactgtctaatgagtgcataatgagggcagtattgctaacgcctatacaatgcacctgcatcaactagaactttgctttaccttggtacaatttttggaaaaatgaaaaacctcttttccatgaaattgaaaaaaaatgtttttgaaaaggaagaaaaaaaagaaatacctgaggctgggtaatttataaagaaaggaggtttaattggctcacagttctgcaggctatacatgaagcatggcactggtagctgctttgcttctggtgaagctttgggctgcttacaatcatggtggacggtgaagcaggagcaggcatctcacacagggagagcagaagcaagagagagagaagggaaaggtgctacacacttttaaacaaccagctctcttgagaactcacttactacaaaagagatggtgctaagtcattcctgagagatctgcccctgtgatccagtcacctgtcaccaggcccaacctccatccaatactgaggattacaattcaatataagattagatggggacaacgttcagactatattacaccactacatgttctagcgtaaatacatattttactaatgttaaatcaaatgtataatagatcattggtttggactgagctcctgtactaggcccaacagacaaaaccaaactggagtcagtcatgctgaagttccacactaacctgctgaaactaagatctttatctgacctttcaacaaatcaggacacagagataacagccaaatccctaaacaggccagttttcgccagcgtgataagaaagttccttaaatcaacctcctctgctcagctcatcagaacactcactctgttttatagtatgaggtgttgtccgattctagaattgcaaataaaagacaattaaaattttttaaaaatatttttaaaattctttattctttttaatagtgatagggtctcactatattgcccaggctggccttgaattcccaagctcaagcaatcctcccacctcagcctcccaaagttttgggattacaggcatgagccaaagcacctgacctcaattaagatctttttttttttttgagatggagtctcgctctgttgcccaggctggagtgcaatggtgcaattttggcctactgcaacctccgcctcctaggttcaagcaattctcttgtctcagcctcctgagtagctgggattacaggcacgtgccaccattcccagctaatttttgtatttttagtagagaaggggtttcagcatgttggccaggctggtctcgaactcctgacctcaggtgatccacctaccttggcctcccaaagtgctggaattacaggcttgagccacagcgcccggccccacataagatctttgaactaaatttgttgtgattttgtcttttgacactaaacatgatacccagtctagaagtcataaagaaaaatggcaacagattgactgcatacaattttaaaacttttgtttggcaaaagaaaacatgaagataaaaaaataacacacaggctgggaaaacgtatttagaacatatataacagaaaagatttatattaagcactcctgcaaatgactaagactataaccaacaactcagtagaaaaatgaccaaataatataacaaaggtgaaccaaaaaataagaaatacaaaaaagcaataaacaaataaaatattcaacctcatcttctaaaaaaatgcaaacaagatacccatcaggttggcaaacattttacgtactaataatattggcaaactctttttagagaaataattggtaatacttaccaaaatctaattttttttttttgagacagggtcttggtatgttgtgaagctggtgttggactcctgggctcaagcagtcctcctacttcagcttcccaagtagctgggatcacaggagcacaccaccacacctggctgcaaaatgtaaatgattttatcttcctttctgtctcttggcccagcaattccacatttaggtatctgtccctgacaacctaacacacaaaattcttatatgtgtataaacatatgtacaagaggaattattaaaggaataggtgtactagtgaaaaattggaaataacctaaatgttcattaatagattaggttaatatattattgaaatttattctatagattattagggcaattgtttaaaagaataaggtaaagctacatataatgacatgtgaagatttctgagacatattgttaggttaaaaatagcatgtcataggacaatatcatattttatcatttaaataaaaatactaggaaaaacctcataatttgctgagagtcattacctttgatgatggggtaggagtgggaaaaaaaggagtgaatagcaactgtcacttttcactccatttacactggtattcctttgatttttaaaaagtgtgttttcatgaattactgtgtagttcagaaataaaaatgcattccctttattttactgttgcattctttctctcttgctctcctctaatacaattctcagacaggatgtgaacagaaagaaaacagtaacgtttattgacttccgtacctcacacttgtgttccagtgtttggctatttatgatttccttcctgtgctctgacagtctctaattttaggtatgcctttatggttagaaacagcattttgttttgcttgaatttttaaaccaacaatctcaggaaagagttatgcttctgtaacactgttgtttagggttcccccccaaccccgtctcataaaagtagcccagaatacttttactaccccagacaaaaatggaccatttaagaataagttcctaatctgttgctaaatgctaattatgagaattagataataacttgtattcctgaaaataatcataatgggaatgcatcttcaggaaattgatgggaattctggatctaaaaggtgcagtgtggttatcttaagttgaaaagtgaaattagcaaaatggctaagaaagccttaacataaaacattaattggggtttaatgatgtaatcttagcagtaggaaagacacataataacattctgtcaaacctttgttagactttcttgtaattttgtcttaactacagcatcgaagaaagttgtgtacaattcattttatgaatcagaacccaattatgttatattgttttcattcttttacccaagagagattcataagttgtttttaatcacttcttttattttaaaccaatagtgtctgccaaatgggtaatatttcccattaaaacattatcttctataattggtataattgcttcataaagagataaaccacagcataattccagagtctttgggtttataaaatctaattatgttcacaacacagtattttattcttagtgatcttaaaaagaacataaacttgaacaaagcccagacatttatggtaaagtaattgggagaagcaagttaattattgtgaatagaactgcctctattagcagcctctgagagaaagccctttttgcagtcattaatctcagtataggaaggtttggttttggtcccctgagcctgcgttgatagcctgtggctaaagtgcagagtaaggttcagttctaaagcacaggcttctcaaggttggtccagcatcccagtctcctaagtatagaagagcacagctcctagcctcagcttttcatgttgcttcagaggcaagggcggagaagagagagggagaagcagagggcacaggtatgacctccaaggtctgtttcaacaggagatttgctttcatccgttttacatttaaggattctacaacagattgcttttttttttttttgcgatggagtctcgctctgttgcctaggctggagtgcagtggcacaatcttggctcactgcaacctccacctcctgggttaggcaccgccatgcccagataagttttgtatttttagtcgagattgggttgcatcatgttggccaggctggtctcaaactccagacctcaagtgatctgcccacctcagcctcccaaagtgttgaaattacaggcgtgagccactgtgcctagccaacagattgcatttggagaaagagaatcaattgctaaaattaatttttgaaaacttttgctcaatgccatagtcatgtgctgtctctatgtcaaagggagaatgactaaatataagaattagccactcaagggaacacactggaaggccaaacagcaacccacattacctgaaaaccacaccttaaaaactcataagcctctcttcaatactatttataactaaaaagaaatcctaattttagtctgggtgcagtggttcatgcctataattcccagtactttgagaggccaaggtggaaggattgcttgagcccaggagtttgagtccaggcctgggcaaaatgatgagactctgtctctacaaaaaatttaaaatatagctgggtatggtgatgtgcacttgctactcaggaggctgggataggggaattgcttgggcctgggaggttgaggctgtggtgagctgtgattgtgcaccagcctgggtgacctgttaaaaaaaaaaaaaaaaaaaaaggaaagaaattccaattaaacacacacacgcacacacacgtacacacctgcacacgtaccaagcaaacatccctaaactgtacttgacttgcacctcctccttggtttttatgtaagaaaagggagggagagggagagaaagatactagagcaggaggaaacgatattccttagtcagcattagtgttgtccagaactatgacactccattttgcttcagcattcctaagtatcaacctgcctttctttgtatttctcttcccttcctccctctgattgataccttgagaggctttttctctcttcttccttcccctttacccataccaagaagcaggacatgcccctttaggaatcagcgacttaaaagattgtgagactcagagaaagaaagttaataatagacacaagagctagatagaaagatgaataggtatgcacttgtcctcagaatctgcagaaaattctggcttaagaaggttaagatgggaggtggggagtggtcagggtggaagataatcagtggcaagttgtacgggagggaaagaagtaaagacattagccactcaaggctttctctatagaaggatttgtcagtggcaagctggctcttacctgagactcagatgaacatcagtatcacttcctgggagtggtctttcctgaccacccagtgtaaagtggccaccgatttgctatccaccacattatcccattttacctctctagacagcacttattatctgacattttcctttatttttttctgcctctctccaccccctacctctggcctcttcccctactaaaatgtaagctccttgggggcaatgacttgtcctaatttactgtctgtctcttccccctaggatataagccccaagcctgcagggattgactggttttgttaaatccatatccttcaaatggccttgcacatataacagtaaggacattcagtagttcaatgaatccttcttgaatacaagaattatagaaagaaaccctttctcccccgcgaagtttgcattgtgataaagcagcttgaatttttcccctgagttgggacaaaggcaggtacattgctcccattgcaggtatagcctcaatttctagtccattgggaccaacaagggctaatggcaaagacagaatcagaagtgtctcctttgtgctgaatagtgatgtgggttaagacaccacagaatgagaaagcagcttccttcccactctagggggcgaaaaggaggcactcgctgcagtggaaacatttgcagaagatcaaacaatgctgtaatcctttaagcttgataaaagcttttttcatgtgtgatagattacaattatggtgaaacgtactataaaaatattcttcacatgttaccagacgtcttcatcaggtttgcaaacatcaaagatttatcttagtcttttgttatttcaatctcaaatgctacctccttcttggctactttatgattctccttttgcaaaagaatcaagcaaaggcatacggcaatttacaagtcaaggtatttaagattagcatttcattagtgatttaaaatatattcctttcagaatatgcaaagtacaaaaaatatatacatattttaggataaacagaatagagtttatctgggggataacttttttttttttttacactatgtaaaagtatcaggggatacttttttttacagtatgaatagtaatacccttttggagcaaaatggccttagtaaatgataaaaagtaaaataaagaggattgtcagtgcaaaaaaaaaaaaaaagataaatttctgatgaattacttacatgctggacattaagtagtcttgagtgaccatatgatttattatccaaataagggatgcttctgagagtgaatgagggcagttattggtcataattaacaataggacaatggacagaaaccagggcaaactgggatatacagtcaacctcatttcaaggatacttaatgaccataaaattgcttttagatttttatcaaaaaaaaaaaaagtaaaacaaaatagcctgctcatttgctaaagacatagtaagcaatgagtctttttaaaattaactgcttgatttttcataataaaattaaatgactaaatatgagtataaattgacaactgttggaggagaaaaagaaattcagtgtgtaatctacctattttaatgaatgaatgaacgaatatttatttattttttagagacggggtcttgctctggcacatgatcattgatcatagcgcactgcagtgtctaactcttgggctcaagtgttccttccgcctcagcctcctgagtagctaggactataggcatgaatttacatgccctactctaccctattttaaactgttctgatcattcagaaaagttgtccttgcccataaatattaatcacaatagtctgctgggtaacatttctcagcttaaaatatgtatttcatttttaaagatcaaccacttttccatattgacatcattggtagatagatttaatctcctactccagtccttatggattgtggccataaggaacactgcttgggaggcttctgagggcacttgtacagctcagtagaaaggcctgttctgattggctggtgatatctgcaggagacatgggatatggggcaatggtaggttcagcaagtatttgccatcaaaacaggtactgaacagatacctgttttaacaataattttctaacatatatctggtttgtaaacaaaaaattacgtcttgctgatcctgcatctgttacctctcataggttctattatagtataaataatatcccaactatgccacaggaaaacaaggccatcactcttgacttaagtgaagacagcaacccatgattccacacattattgtttcacagcgctgttagtcccaaatcacactaagatcaaatccctaatacctggagagtaggggaaaaaaataatacagcaaacgactaacttctcttctgtttctattcttcacttattttgtcatttggggctatatttttatctactcaagagaattttaagtgataaaatgaaaattaaacttgcctctccctttgcaagcaagtattagttattctttttttttttttttttttttttttccagacagagttttgctcttgttgcccaggctggagtgcagtggcacaatctcagctcagtgcaacctctgccttcctggttcaagtgattctcctgcctcagcctcccaagtagctgggattacaagcacctgccaccatggccggctaatttttgtaattttagtagagacagggtttcagcatattggccaggctggactcgaactcctgacctcaggtgatccacctacctcagcctaccaaagtgctgggattacaagcatgagccaccacgcctggcctaatgattctattttaaaggaaaattttcagcatttattttactaccaggtattttgcattatttaccctttctgtacacaatagagagctgttttgcatctttcaatgagggaaaataaagaggaaatagttgactctataaaaaatacatgaggcgtccacataatgctgtttttgtgcctgtatgtgtgaccatgaagcatgttccaccttcgggaccttaattctctaattttaagaaatgaggcagaagaatggctaaaattaaaaaggcatggagctcccgggaattcttacatggtgatggtaggagcacagaaatgtcactactctggaaacaagattggtagaactgaaacatatgcttatcatatggcccagcaatcccctacctaggtatttatccaagggaaatgaaaacatgtgtccatgtgaagatttgtatgtgaatacatttttttcaaaaagaggcagaattcaatttctattgcagggaaaacccaagttcagattgcaaggcagctttctcatattgattttgaccacacagctctacttttccaagagtgaaatcctattgaagtggctttccaaaatattttgtggaaaataagtattaatagatggcaactcctcattcacgatccccaaacaggagacaaattcatcaggaagcagggtctgttctggaatagtttcactgggtgaatcattttccaaaagcatggtggtttcctcctctactgagttttgtatgtcaggagaactgcattctccttgatttaatatgaggcttaattctccaagaaatattgtgttgcttagtgaattcacacttgaaacagaaaaagcaaaattaggatgcttttgtaacctgggattatttcctgagtctaaggaatcaactggtggtttaagtgttaaggaagtaatttcattattattgctgagatggcttccctcaggcagaaaatttgaaatttggggtttatatccagtgttgagatcaggaatatatacaactgtagtattgtcgaatagcgagttttgcgggtagtctcttgtctccaggggtcctgtattctccttcttgtagtctgtaggcttgtgttctgggatgaagatttcttttatctctgtaatcatgggatcaacatataggacctgctcactggaattattattcataagttcactattttcctaggaaaaaaagacatcattttattttgcaaaagacatttaaaagaaccaactggataattgaatgaggataggaattttgctttctttcaactttcctttctccctccattttctcatattgtttatcttcccatatgatttcctccttttgtcttttgttatcctgcttgcttccaaatctttattaaatttgcatgagaagactgaagaaaaggaatagtaaaaataatccacttcttaagcacatttcttggtttaaaagttttaaagagaaaagttgagtcttatatattaacttattacttattacttaattttagggccttttaaaagttggtcttctgaggcaagaatattaatattaatatttcttgttacaagaaaatactttgttgcttaaataaaaaaaggttggggagaatcctattttgctcacataccgagaatgagtgtgtgacaaatgcttgatgccgaggttctaaaggtggataaggcctgtaatcccagcactttgaggccaaggcaggcagatcacttgagatcaggagttcaagaccagcctggccaacatggtgaaaccctgtctctactaaaaatacaaaaattagccaggcgtagtagcgcaagcctgtaatcccagctactcaggaggctgagacaggagaattgcttgagcccgggaggcggaggttgcagtgagctgagatcatgccactgcactctagcctgggtgacagagcaagactctgtctcaaaacaaaaaacaacaaataaataaataaagctactcacaattcagacatgtttgtgatgataaggagggtgggtgaaggttttagcctgatgacttttctgggcaataaatggactggaggccttccaacagatggctggccttcctgggcaaactgtcacccaacacaattataatattatagccccctgttacggactaaacgtttgtgtgccctctccccagcccccctcacattgaagccaatgtgatgttatttgaaagtggagactttgggtggtaattaggtcatgagggcggagccttcatgaatgggattagtgaagaagagacaggaaagagatgatctcttcctctgccatgtgagaaggcagctgtccacaagacagccctcactagcaagtgaattgactggctccttgatcatggacttcccagcctccagcactgtgacaaataaatgtttgttgtttaagccacccaagccgactaagcattccttagtctctcgggcagaaaacaaaaccttatctgagggaagccctaaggtttgcctctaattccaggagcccagaataggaaaggagtttagcaaagaaggagatcttgaataaacagacatgaagtgtcattccaattttcttcagccccagcctccttagggagcttgccaggtttgggtaagaacagcacattgggtattgcttcatcaaaaatcttgacgtgaggagtggctggagtaaagctggaatggtgagtggatcagatcacagaagtcttgtgttacagaactcagactctattctgttgaccagttgtttttgaacttttaaaaagtattttatttttagcctagaaaccctttgttcagatgacatgaggttggggaaagagttagctaataggcttaccagagcttgaaacagagccacttctatttgttttacaaacacctcatcttcttacccaacatgcagttctaacccccaggggtccccctgactttgaattctccctgcttctcctgagcagctcctctcctttcagtgtttcctttccactcccatcacatgtttgggctcatttctatcattgcacttacatcactgcattgcaaggcttggatgatgtgtttgtcccttggactgggttttgagccccttgacagccaatcccgagggccaggggttatcaggaacacacatagcttgttccttccctcctttataatcagtaatgtccctgtaccctcaggggcttcctggtgtgtggccttctctttgccagaatggaaacctagcccacccctgtgacactattgttcacagttctctcacattgcttttctcaaattccactgggtttaaagagtaaaatgatgcccttcttgggctccacctggctctccatctcatgtgaaacagaagccctttgaatctttgaggctcatttcattgagcttttcttccctactccctttgttcctgaagacatctaccattgtttggtcaccaggtgactcgtgcacaaggcccacaatcttccacttcacttttctcttttgaacaggtttgtttctttatttcttctctgttttctttcccccaactctattgtctcatctcttttaagtatgatttgaaacaggtacagttttgtctttacacatgtctatataattatgttaatatgtgtgcacatttatttatttgaatggaaattctattctaattattagactgcactcttggtctcaattgccactcagtttttgttggatgatgttaggttacctgtagcattttcacaacattgctgtttttcatattaggaatatcttcataaagccactttggtattaacaataagatccttcttttaatcctaaaaaacaaaaatgacacgttagaagaagcaggcaatcatataggagattaggaagtcaactagaataaaatgtatattaaaaatcaaatttcctaggtcgggcacagtggctcatgcctgtaatcccagcactttgggaggctgaggtgggaggattgcttgagtccaggagttcgagaccagcctgggcaacatagcaagaccctgtctctacagaatattaaaaaattagctgggtgtggtggtgcatgcctgtggtcccagctacttgggaggctgaggtggaaagatcgcttgagcctgggaggtcaaggctgtagtgagctgtgaccatgccactgcactcactctgggcaacagagtgagaccctgactcaaaaaaaaaattaattaaagaaatcaaacttcctgatgccgaggctaaagttttcatctcttacttaatgaaaattaagtgggaaattgtgtcattatcttttcagattttcctctcatctctattgctctgcttcttttcaatgagcagaaacatttcaaaacactcacactagattcaagataagtgggagaaccaccctagcagtgaaaccgtacacatattaaatagagcaaactctcataaccagaagattcccatgtgggaaagttcgaaaaacttaagggatattttgtagaactttccaaggtgaccgtaactaccgcatatttaaaaagagaatgttatataataaagccctaaaatttaggctgttctgagtctagattttgtaattatttcaaatagggttgtaatgatggtgacagctccaaactttcttgatgcggatggagaaggaggctggggaacatgtcttgcagttgtgtggcatagtgagaactggtttctacctagaccatgtgcttattttaaggatcagtggggtggggctttggaaagaaaaggtagaagtcataaacatcccactttttcccccaagctatctattagcactgccattgtgtttaaaaacactctctgcattgacagtacaaattggtttgggcagaaaggttgtaccaagaacttagaagagactaaactgatctcagacacctttttacatattaacaatggatcctgttagcaacggatcagacttatttgtttaaattggttctcaaaggacctgtactaaataacaaccaaaatggctgagtgaactttgctagcccaatttgaccttggactttagggtaaatattatttctttactcatctttatacaatgttttatgattccattttttttgttgttgttttgtttactaattcacactctcttctgtatttaaaattagaccaaattagtaaattcaggctattggagtaaagtttttatacagtacactgatacagtgagaatatatatatatatatgtatata

SEQ ID NO: 24 - DNA, 201 bp, Homo sapiens
ctgtgtgcccagcacttcctctgcatgcctcagatgcatttgacaatctcaggtgaactgcacttcagggtcaagggaaccccggccatggttctaagaarcaactcccattttagtatcacctacatttgaaaccacagagcactgtccaggagaggtgatggtggtgggtctcctcctttggctctctggcccatcagc

SEQ ID NO: 25 - DNA, 201 bp, Homo sapiens
aattacttaaatatttaaatagcatgaaggcccatggcaacttgagagctggaaaatctatacataaattagctgattgtttcaatgagcatttagcatckaactatacaaatacagcaaagatatcattgtgatcctaaaaaaacgttttaaagcaaatcagatagaaattatctttttgggtctattccgttgtgtctt

SEQ ID NO: 26 - DNA, 201 bp, Homo sapiens
ggctttgtccagtgattttaaaagtggggtgaaaggagtctggggcggtacaaaagggcctctggaaccttgcaacaggcaaaggaattctgctgtaaggygaggaagctgggaagccaatatcttagcctctataagtgtagacattctgtttagtaaaataattttataatatctggaacagccaggagctatccattt

SEQ ID NO: 27 - DNA, 201 bp, Homo sapiens
cccctctgactctctctgcagagagtgtagcagctccgcacgtcaccccttgggggtcagaagagctgaagtcaaagacagaaattagcctgtgttacacmttggggagagagttcctagtgattgtagccagtaaggcaggtaaggcctcaactgttgtctgaggacacagtttctccaactgggctgatttctacccag

SEQ ID NO: 28 - DNA, 201 bp, Homo sapiens
gtctgcttcagggcccctaagatctacgccctggagctcttgtttttatttttgactcaaggtgcaatttcagcaagtcatttgtagctttgaattctccktttatccctttctttggtgctatgaggcttcaggaagcatggccaggcaatttggatgagtgggttcaaacacagcagagactattctcagttcccaata

SEQ ID NO: 29 - DNA, 201 bp, Homo sapiens
tatctgccttacatttgactgaggattaaatgaaaaaaaaaaaaagcacgtaaagtacttagcacagtgtctgccacacagtaaattcggtgttagttatygttacttatagactgaggagtcagccaactgtacagagaaactctcttaacaattttccatggatatttaaggatttcgttccctctgttttaaatcacc

SEQ ID NO: 30 - DNA, 201 bp, Homo sapiens
ttcatggagccatattttctggtcataattgtgtatcaggttcattcatgctaatgagaaagggattccagattttctttgcatctgtctgcttctcacakggctgttaagaagccacctgccattctgacaatttcatgtccttagccataactacttgtcctctctcttgaatcttaagatctttttgccttccagaca

SEQ ID NO: 31 - DNA, 201 bp, Homo sapiens
gcaatgctcaactgtttcagtcaaataccttaaaaatgagcattcctgggttgggtgacggaatattgacaaattacagctttgtcagaactgctactaastctaggcggaccttgctatgtactttattcccttataaagtttgtgagtggcagagacaggcctagaagtcaagccttcttggacactgctcagtgctgt

SEQ ID NO: 32 - DNA, 201 bp, Homo sapiens
gcctctctgaggaggtgacatttagctgacaccaaaaggaaagatgtcagttgtgttaagagcagagggaagcatatgtgcgaagcacctgctaggagccrtgatctttgtgtggagcagtgccaggcctacagagcccaaccacacaccctagcatgtctctgcctcctcttatctagaagacctaattgaggaaggagt

SEQ ID NO: 33 - DNA, 201 bp, Homo sapiens
ctcttatttttaagatgagaaacttaaagcttagagaaggaatgtgactttctggatcaacatctagcagttgtttatttagtgcttactacataaagagmactgggctagaagcagttgagagagaaaaaaagggcttacctggatcccgcttcctaggagcaaatacttttactcaataaatatttattaagtcagtgt

SEQ ID NO: 34 - DNA, 201 bp, Homo sapiens
agattgtgattcagatctgggatggggctcaggaacctgcattttaacaatggaggttctaatgtggtcattggcaggttgttctaatgtgggggccacagcctctctcggagacaggctgtacatggccagccagcattctggtaatatgagccaaatgcccattgacctaattttggagaagaggtttatcaacatgtc

SEQ ID NO: 35 - DNA, 201 bp, Homo sapiens
atagcttttcattttttaactggggccaaagttagttaatccacaagaatggggatcccagctgtcattttggttgatatcacaactgacgaccaagaccrtcacaaatatgggagcaagtctgatttgtaacattattataattatgaatccaattactttaaggaatgcacgaaaggctttttaaaaatttcaatagta

SEQ ID NO: 36 - DNA, 201 bp, Homo sapiens
gcttcccaacactggtgccaacatcagcatgccaatgacgcttgggtgggcatctcttttttaagttttgtttgttacctttaattagaaaagggagttaytattaaagaataaaaagatatagtcacagatggcatgggtggcacatgcaaagatccctagtttgagggccaggcagacttctagaactgtgtgactctg

SEQ ID NO: 37 - DNA, 201 bp, Homo sapiens
gagaaacttccagcacaatttcagtttcatagagaatacggcagggcacaatattcagcagagtaacatagtggttaaaagctcagggtgtcgagaacaaygaaccaagactgtcatcctgtctccactaaccagctgggggatttggaacaaggtatttcattatcatgagcctcagtttcctcatctgtaaaatgataa

SEQ ID NO: 38 - DNA, 201 bp, Homo sapiens
ttagacaacagaggagacattggacttttattgggaatgatcgtctttgctgttatgttgtcaattctttctttgattgggatatttaacagatcattccraactgggtaggtttttgcagaatttctgttttctgatttagactacatgtatatgtatcaccaaaatttagtcatttcagttgtttactagaaaaatctg

SEQ ID NO: 39 - DNA, 201 bp, Homo sapiens
aacccggtacctcagttggaaatgaagaaatcgttcgtcttctgcatcattcacgctgggagctgtagactggagctgttcctattcagccatcttggctygggaccagagaacttcgtatttcttacagcacctcctaagtgttatgttttgttgcagatccgccagatattcctgatgaagtaacctgtgtcatttatg

SEQ ID NO: 40 - DNA, 201 bp, Homo sapiens
aattgaacccaggccaccactgtgaaagtaaaaaactttagctactgagctacagtactgggtagtctccattgtgcttcccagaagggctctaaagtacktaattttgagcttgcaaaagcttttaactactcaacttaatttttagagctaactgtgacatgaaccctaaaattcctgttcccttgaaggcagagacca

SEQ ID NO: 41 - DNA, 201 bp, Homo sapiens
gtgcaacagtcagaattctacttggagccaaacattaagtacgtatttcaagtgagatgtcaagaaacaggcaaaaggtactggcagccttggagttcacygttttttcataaaacacctgaaacaggtgagtgtacttatatattttattctgttgggcttttctttatatatcttttctgctgagcacagtggctcaca

SEQ ID NO: 42 - DNA, 201 bp, Homo sapiens
acccactgacatcagatacatgtagcccaactttctcaaacaaaaagttgtttcctggggtagttgtgcactctggaaaaacagtcactctgtggcctaargtaaaggttaattttgcttccccccaccctttctcctttgagacctttgctttgagcagagtaaagagaatagtaattctggtatcaaatgaagactaat

SEQ ID NO: 43 - DNA, 201 bp, Homo sapiens
atgacacatggaattctgggctaacagttgcttccatctctacagggcaccttacttctggtaagaaaatacaacttaggctttttgagtagtcttttagkaattgcccattttaacccatcatactgaaaaaatcacatcaggtgttaagtttctggacaataagatatgccttatgtcttccataggaaaataatagac

SEQ ID NO: 44 - DNA, 201 bp, Homo sapiens
catcctgggccacacgcagcccaggagttggacaagcttagtctacaatttcaaagaagtaacttgctgaggtaacatatttactaggtaaggaaacaatytgtatcaagtctgattctaaagttaattttcctttctactaaccatgctgcctacctaagtggaatgaactagattgtgaaaacatggattcaagttaaa

SEQ ID NO: 45 - DNA, 201 bp, Homo sapiens
ggttactaacagcactgaacattatcaataagtatatgaaaacatttgcaattatttggtgaaatgttcacattctttgcccatttttctgctagaatacrtatcctactgcctgatcgaaatagtaatccttagtcacatgattgcatttttctaatatgtcccttgtcttaatattttaaataactttattctcttata

SEQ ID NO: 46 - DNA, 201 bp, Homo sapiens
gagctaatgctcccagcccttatatagtatctacatcttaagctttaattttcaaagaagaatttcactgatatagatgaggaattcattcaggcaatcartgcttgtcccttactatgcagctccatgcttctatatagttatctttcctacacaattgcttattagttggtttttatgtgaaagcatctaattttacat

SEQ ID NO: 47 - DNA, 201 bp, Homo sapiens
gccaaaaatactattgacacaaacatgcatcacaactcactctacagcattaaccaaacaatccataacaaactaagttgacaatggcaaagctgttagtktttaaattatacacagtaatttgtaattaaaaagcaagaccagtggcatttaaaaatgatgacctaggccaggtgtagtagtgcacacctataatcccag

SEQ ID NO: 48 - DNA, 201 bp, Homo sapiens
aaagatgcagggtgtgctgggtatttcttaattattattattattattatcatatctgctaaatcactcctcgctcgacatttaatacagggtgatagacmaaacactgctgatttggggtttgccataatgactgacctgagcaaaggctttgtgtacaaagtggctccccattaaataagggctctgtggaaccagctg

SEQ ID NO: 49 - DNA, 201 bp, Homo sapiens; identical to SEQ ID NO: 34

SEQ ID NO: 50 - DNA, 201 bp, Homo sapiens
ccaatcccctaccaataccaaaggacaactgttacatcataagctcttattacttaacattcattattcattcattcagcatatatttattgagcatctaygttagccaatatcatgctaggttctgagaatggaaaggtgaataaattgtctgttccttaacaaaatttactgatatggtttgtctttgtgtccccaccc

SEQ ID NO: 51 - DNA, 201 bp, Homo sapiens
caaaggcccccttccatttctcctctccagagtgttccagtaagaacatccccttctagctatttcacacatggacaaccaagaaatagtcatttacagarcattttgcatttgtacaatttcactcgttatttctcccccagtacctaatgggggctgcagcgtgtactctgttcgtggttaaattctgctgccagaagt

SEQ ID NO: 52 - DNA, 201 bp, Homo sapiens
tcccatgatggtcaaggaataattttggaggagacgtttaactttaaaaaaaaaaatacaatcattagtttcatgtttgtttaaaagaaactttgttttcstaaccaacatttgagctccattcatctcttgatgcagggagagatgttattgtaaatgtctagttctttatgttactttacagtagggtttttaaaagac

SEQ ID NO: 53 - DNA, 201 bp, Homo sapiens
gtccaccccctgacaatgatgatgttgttaatgactttgatattgaagatgaagtagttgaagtagaaaataggtaagtgcttttcgctttagaagtaatsagttgtcatgtgagaacaagtgaatattttatctaattatatgttttccattagggaagaaaacctactgaaaatttctcgcagagtgaaagagtacaaa

SEQ ID NO: 54 - DNA, 201 bp, Homo sapiens
tgatatatatatatgtgtgtgtgtgtatatatatttttttatttttttggccagaaagtattctagtttatggatgcatcatcatttaaccatgttattcmctgttgattataaataattttttataaggaatattttaaaaattatgtttgatattttatcactagttttctgtttagttatattcaagcagattcttga

SEQ ID NO: 55 - DNA, 201 bp, Homo sapiens
agggaattgtggggtcagagcccccatacagagtccctactggggcactgcctagtggagctgagagaagagggccaccaccctccaggccccagaatggsagatctgacaacagcttgtactgtgtgcctggaaaatccacagacactcaatgccagcccgtgaaagcagctgggagggagggtttaccttgcaaagcca

SEQ ID NO: 56 - DNA, 201 bp, Homo sapiens; identical to SEQ ID NO: 24

SEQ ID NO: 57 - DNA, 201 bp, Homo sapiens
ccacttccaacattggggatcaaatttcaacatgagatttggagggacaaatatgcaaaccatatcaggtgttgatggtgaaggggtgctgtgtttctttytggggtattgaaaatattccagaatttattgtggtgatgggagcacaactctgtaagtgtataaaacctgttgaattagacaccttaaaagagtcacttg

SEQ ID NO: 58 - DNA, 201 bp, Homo sapiens; identical to SEQ ID NO: 25

SEQ ID NO: 59 - DNA, 201 bp, Homo sapiens; identical to SEQ ID NO: 26

SEQ ID NO: 60 - DNA, 201 bp, Homo sapiens; identical to SEQ ID NO: 27

SEQ ID NO: 61 - DNA, 201 bp, Homo sapiens; identical to SEQ ID NO: 28

SEQ ID NO: 62 - DNA, 201 bp, Homo sapiens; identical to SEQ ID NO: 29

SEQ ID NO: 63 - DNA, 201 bp, Homo sapiens; identical to SEQ ID NO: 30

SEQ ID NO: 64 - DNA, 201 bp, Homo sapiens; identical to SEQ ID NO: 31

SEQ ID NO: 65 - DNA, 201 bp, Homo sapiens; identical to SEQ ID NO: 32

SEQ ID NO: 66 - DNA, 201 bp, Homo sapiens; identical to SEQ ID NO: 33

SEQ ID NO: 67 - DNA, 201 bp, Homo sapiens; identical to SEQ ID NO: 35

SEQ ID NO: 68 - DNA, 201 bp, Homo sapiens
acagacctagttagaccatagtccatatttcaaatataattacatgtgctcatagctgagaaccttctcctgggatggatgcatttcaccaggtcactgcygaaatgttgtacttttatggatggtgatgaggaagcatctgttttaggtgtggtatttcctggaggcagaaaactgcttgagttagctcattcagttttt

SEQ ID NO: 69 - DNA, 201 bp, Homo sapiens; identical to SEQ ID NO: 68

SEQ ID NO: 70 - DNA, 201 bp, Homo sapiens; identical to SEQ ID NO: 36

SEQ ID NO: 71 - DNA, 201 bp, Homo sapiens; identical to SEQ ID NO: 37

SEQ ID NO: 72 - DNA, 201 bp, Homo sapiens
atcctcagaagtgggcggcagagaaggaggaacgtgcttgagtcgcagtccccaaaaagggaggaactcattggcccagcttaggcctggtgtctgcctayctgtggttcagtcagctgtggtcggtgggcaggacacacctgaaggagcatatcttggctgtgtgggttgggcagacatcccacaatgctcatgtagggg

SEQ ID NO: 73 - DNA, 201 bp, Homo sapiens
tcaaagcagaaccttaggctctaagggaaacaagacagaaggattctgctgacaagacagtaaagtagcctgctcatctggtggtaggcactgtgtcagcrttctaggttgtaaatgtaggaagtaagcagatcagaggtttgctcaacaacctgcctagtgagccaaactgcttgctcttgaggccatgtagtccttctg

SEQ ID NO: 74 - DNA, 201 bp, Homo sapiens
cactaatatgagaacaatctctttaggactggaaaccacgaagtcaattgaattgaatgcaccacaacccagtgagttaaatctttgtggaaagattccasaaatgcctctaaagttgcatctataagcttaatgatcttatgtctgtgtctccatggatgccaagtgatatgatttggatctctatccccacccaaatct

SEQ ID NO: 75 - DNA, 201 bp, Homo sapiens
ctgacttgcttcatacttcttcctgcctccgctagcctccacccagggaaggtgtgcttctcggtaagtcagtttgagagaagcagtgtagtgtagtggtsaatagtctggatttacatctttgatcttccatttactacgcttgtgacctagggggtgttgcttcccctctctgttccaattatttatccataaaataga

SEQ ID NO: 76 - DNA, 201 bp, Homo sapiens
taaatttccaactcatgccttttgggggacacattcaaactatagcaaatactaagttaaggaagtttcagctctgtctggcagcctcataatatttcaaygcttcatcatttgaatgcttattaattaaccaacttcctgtatgccatgtgatcagatgtcacaagaggagttcctttgggatgaacttagttctttgtg

SEQ ID NO: 77 - DNA, 201 bp, Homo sapiens
tgcttactagagaccaaaatgccaagatttcaacgggggccagccaccctggtttctattttgatgtgattacttagtcatttaaagtcaggttaatgttsgccaacaacagatggggtcaggacacaggagttctgcagctcactggaactggacagtcttttagggcacccagctcacaaggccacaccgtggcccgcc

SEQ ID NO: 78 - DNA, 201 bp, Homo sapiens
tgttttaggatcaaaataatgaaaaagaatagaaaccatttcaactcagaaaataattcaaagatgggaaaaaggtgtgtaccaaattcattgctctaatyatttctgttctgataaaaggagtttacagcaaaggaataacttttctgtgtctctgaggctttggaaaaacaaggcatcaagaagctttggggtgtggtg

SEQ ID NO: 79 - DNA, 201 bp, Homo sapiens
gtggtctgaacgtttatgtctccctaaaattcatatgttgaattcctaacccccaaggtgagagtgttgggaggtggagccttttagtctcctggctgggmttagtggcctgataacatagactccagagagctggcttattccttccactatgtgaggacacagcaagaagccgctgtctgtggggaaacagaggcttac

SEQ ID NO: 80 - DNA, 201 bp, Homo sapiens; identical to SEQ ID NO: 68

SEQ ID NO: 81 - DNA, 201 bp, Homo sapiens; identical to SEQ ID NO: 68

SEQ ID NO: 82 - DNA, 201 bp, Homo sapiens
cttctttattttctcaacaatgttttgcagttctcagcatataactttcatttcttttgttcaatttattcctaagtatttaatactttttggtgctattkcagatgaattttcctattaattttcatattggtcattgcaattgtataaaaatacaattatttttgtatattgatcttgtttcatgcaatcttgctgtga

SEQ ID NO: 83 - DNA, 201 bp, Homo sapiens
taaataaaataaaataaagtagaaaagaaacaaaaattataagatagggacattaaatggagttagaaatgaggctaataaataatgaatatgctgcaccrtggaatactactcagccataaaacagaacaaaataatggactttgcagcaacttggatggagctggaagccattatcttaagtgaaataattcacaaatg

SEQ ID NO: 84 - DNA, 201 bp, Homo sapiens; identical to SEQ ID NO: 50

SEQ ID NO: 85 - DNA, 201 bp, Homo sapiens
taaattgaaacattatgtggcctttcgtgtgggttctttaacttaggatagtgttttcaagtttcatccatattgtagcaagtatcagcacttcattccaytttatggctggatgacattccaatgtatgggtctgccatattttgttcatgccatttatccactcatggatatgtagcttgtttccactttctgcccatt

SEQ ID NO: 86 - DNA, 201 bp, Homo sapiens
gctttctaccaacagatgtgcagggtatttttccctctgcccttgtttgttcattaatccatggtaggggacaccaatggatggtcacagttatgattccycccatcaatgtgttttgcttggttttcatagcatttttaattatttatttttggagacagagtctcattctgtcacccaggctggagtacagtggcgtga

SEQ ID NO: 87 - DNA, 201 bp, Homo sapiens
agcttgaagagactaagagcaggcaatccaagtctcctccacatgtggaaaccaagtccagagacggagcagtaactgcccggctcccacggcttgtaatygcagaaacaagctttaagccggctgcctccttcctcgttgcttttaccattatttaatttgtaggcttcacaaaggctatatgtgttgaaattggctaaa

SEQ ID NO: 88 - DNA, 201 bp, Homo sapiens
cagtggaaataaatatttgatgttattttcaataaattgttactggagttaaacctcttgctatcctgacaattcctccctacatcaccctctttgcaatrgcagatggaagaattggcaataaatgcaattcagcttgaagaaaacaccctaaatattagaaacctgtgaagaaccaccggattgccttatcaactcatt

SEQ ID NO: 89 - DNA, 201 bp, Homo sapiens
ggcctccccagccatatggaactgtaagtccattaaatctcttttttttgcaaattgcccagtcttgggtatgtctttaccagcagcgtgaaaatggactwatacagcatttaccacagtgtctggctcatagtaactgtggcagagcctgctaattgtccgttcaacttccgttctcaaattcttacttcctaacagaac

SEQ ID NO: 90 - DNA, 21 bp, Homo sapiens
actaggaactctctccccaat

SEQ ID NO: 91 - DNA, 20 bp, Homo sapiens
ctaggaactctctccccaag

SEQ ID NO: 92 - DNA, 20 bp, Homo sapiens
tgttgtcccctctgactctc

SEQ ID NO: 93 - DNA, 18 bp, Homo sapiens
ggaattctgctgtaaggc

SEQ ID NO: 94 - DNA, 20 bp, Homo sapiens
aaggaattctgctgtaaggt

SEQ ID NO: 95 - DNA, 20 bp, Homo sapiens
ctcctggctgttccagatat

SEQ ID NO: 96 - DNA, 20 bp, Homo sapiens
tgcaaaaacctacccagttt

SEQ ID NO: 97 - DNA, 20 bp, Homo sapiens
tgcaaaaacctacccagttc

SEQ ID NO: 98 - DNA, 24 bp, Homo sapiens
ttcattagacaacagaggagacat

SEQ ID NO: 99 - DNA, 19 bp, Homo sapiens
cggccatggttctaagaaa

SEQ ID NO: 100 - DNA, 19 bp, Homo sapiens
cggccatggttctaagaag

SEQ ID NO: 101 - DNA, 21 bp, Homo sapiens
gaaatgtgggctgagggatag

SEQ ID NO: 102 - DNA, 27 bp, Homo sapiens
ttacttcctacatttacaacctagaat

SEQ ID NO: 103 - DNA, 25 bp, Homo sapiens
acttcctacatttacaacctagaac

SEQ ID NO: 104 - DNA, 25 bp, Homo sapiens
gaggagacctcaaagcagaacctta

SEQ ID NO: 105 - DNA, 27 bp, Homo sapiens
gatcaaagatgtaaatccagactattg

SEQ ID NO: 106 - DNA, 27 bp, Homo sapiens
gatcaaagatgtaaatccagactattc

SEQ ID NO: 107 - DNA, 29 bp, Homo sapiens
cctctgtgttcacactgatatcaatacct

SEQ ID NO: 108 - DNA, 23 bp, Homo sapiens
tggcagcctcataatatttcaac

SEQ ID NO: 109 - DNA, 23 bp, Homo sapiens
tggcagcctcataatatttcaat

SEQ ID NO: 110 - DNA, 25 bp, Homo sapiens
cacaatggtgcacaaagaactaagt

SEQ ID NO: 111 - DNA, 29 bp, Homo sapiens
aattaactttagaatcagacttgatacag

SEQ ID NO: 112 - DNA, 30 bp, Homo sapiens
aaattaactttagaatcagacttgatacaa

SEQ ID NO: 113 - DNA, 20 bp, Homo sapiens
cagcccaggagttggacaag

SEQ ID NO: 114 - DNA, 22 bp, Homo sapiens
gatggtcacagttatgattccc

SEQ ID NO: 115 - DNA, 22 bp, Homo sapiens
gatggtcacagttatgattcct

SEQ ID NO: 116 - DNA, 22 bp, Homo sapiens
cctgggtgacagaatgagactc

SEQ ID NO: 117 - DNA, 18 bp, Homo sapiens
ctcccacggcttgtaatc

SEQ ID NO: 118 - DNA, 18 bp, Homo sapiens
ctcccacggcttgtaatt

SEQ ID NO: 119 - DNA, 27 bp, Homo sapiens
gcacatttagccaatttcaacacatat

SEQ ID NO: 120 - DNA, 21 bp, Homo sapiens
tggagctcaaatgttggttag

SEQ ID NO: 121 - DNA, 21 bp, Homo sapiens
tggagctcaaatgttggttac

SEQ ID NO: 122 - DNA, 23 bp, Homo sapiens
cctgttcttgcaaggaggtgatc

SEQ ID NO: 123 - DNA, 28 bp, Homo sapiens
ttagtcatttaaagtcaggttaatgttc

SEQ ID NO: 124 - DNA, 27 bp, Homo sapiens
tagtcatttaaagtcaggttaatgttg

SEQ ID NO: 125 - DNA, 17 bp, Homo sapiens
cggtgtggccttgtgag

SEQ ID NO: 126 - DNA, 25 bp, Homo sapiens
gtgtaccaaattcattgctctaatc

SEQ ID NO: 127 - DNA, 25 bp, Homo sapiens
gtgtaccaaattcattgctctaatt

SEQ ID NO: 128 - DNA, 23 bp, Homo sapiens
caaagcttcttgatgccttgttt

SEQ ID NO: 129 - DNA, 18 bp, Homo sapiens
actgcttctagcccagtg

SEQ ID NO: 130 - DNA, 18 bp, Homo sapiens
actgcttctagcccagtt

SEQ ID NO: 131 - DNA, 23 bp, Homo sapiens
acctaaggcaagccatctgatac

SEQ ID NO: 132 - DNA, 17 bp, Homo sapiens
ctgtctccgagagaggg

SEQ ID NO: 133 - DNA, 19 bp, Homo sapiens
tctccgagagaggctctaa

SEQ ID NO: 134 - DNA, 21 bp, Homo sapiens
gggctgatgcttggagattgt

SEQ ID NO: 135 - DNA, 17 bp, Homo sapiens
gctgactgaaccacagg

SEQ ID NO: 136 - DNA, 18 bp, Homo sapiens
agctgactgaaccacaga

SEQ ID NO: 137 - DNA, 18 bp, Homo sapiens
gaagtgggcggcagagaa

SEQ ID NO: 138 - DNA, 25 bp, Homo sapiens
cacagtaaattcggtgttagttatc

SEQ ID NO: 139 - DNA, 25 bp, Homo sapiens
cacagtaaattcggtgttagttatt

SEQ ID NO: 140 - DNA, 22 bp, Homo sapiens
tccactggtgatttaaaacaga

SEQ ID NO: 141 - DNA, 17 bp, Homo sapiens
cagccttggagttcacc

SEQ ID NO: 142 - DNA, 18 bp, Homo sapiens
gcagccttggagttcact

SEQ ID NO: 143 - DNA, 23 bp, Homo sapiens
tgtgctcagcagaaaagatatat

SEQ ID NO: 144 - DNA, 22 bp, Homo sapiens
gatgcaactttagaggcatttg

SEQ ID NO: 145 - DNA, 22 bp, Homo sapiens
gatgcaactttagaggcatttc

SEQ ID NO: 146 - DNA, 25 bp, Homo sapiens
ttaggactggaaaccacgaagtcaa

SEQ ID NO: 147 - DNA, 21 bp, Homo sapiens
ttcgatcaggcagtaggatat

SEQ ID NO: 148 - DNA, 20 bp, Homo sapiens
tcgatcaggcagtaggatac

SEQ ID NO: 149 - DNA, 28 bp, Homo sapiens
cattttgttggttactaacagcactgaa

SEQ ID NO: 150 - DNA, 26 bp, Homo sapiens
caaccaagaaatagtcatttacagaa

SEQ ID NO: 151 - DNA, 26 bp, Homo sapiens
caaccaagaaatagtcatttacagag

SEQ ID NO: 152 - DNA, 23 bp, Homo sapiens
atcaggagctggaggaaacttct

SEQ ID NO: 153 - DNA, 19 bp, Homo sapiens
ggggtgctgtgtttctttc

SEQ ID NO: 154 - DNA, 19 bp, Homo sapiens
ggggtgctgtgtttctttt

SEQ ID NO: 155 - DNA, 34 bp, Homo sapiens
ctaacagctgtaatgaggtatagttcacatactc

SEQ ID NO: 156 - DNA, 23 bp, Homo sapiens
gctttgtcagaactgctactaac

SEQ ID NO: 157 - DNA, 23 bp, Homo sapiens
gctttgtcagaactgctactaag

SEQ ID NO: 158 - DNA, 23 bp, Homo sapiens
cagtgtccaagaaggcttgactt

SEQ ID NO: 159 - DNA, 24 bp, Homo sapiens
agtctatgttatcaggccactaat

SEQ ID NO: 160 - DNA, 23 bp, Homo sapiens
gtctatgttatcaggccactaag

SEQ ID NO: 161 - DNA, 25 bp, Homo sapiens
gatgctgtggtctgaacgtttatgt

SEQ ID NO: 162 - DNA, 20 bp, Homo sapiens
caatggcaaagctgttagtg

SEQ ID NO: 163 - DNA, 21 bp, Homo sapiens
acaatggcaaagctgttagtt

SEQ ID NO: 164 - DNA, 25 bp, Homo sapiens
gctgggattataggtgtgcactact

SEQ ID NO: 165 - DNA, 22 bp, Homo sapiens
ggaatgtcatccagccataaag

SEQ ID NO: 166 - DNA, 22 bp, Homo sapiens
ggaatgtcatccagccataaaa

SEQ ID NO: 167 - DNA, 24 bp, Homo sapiens
gcctttcgtgtgggttctttaact

SEQ ID NO: 168 - DNA, 16 bp, Homo sapiens
tcaccaggtcactgcc

SEQ ID NO: 169 - DNA, 17 bp, Homo sapiens
ttcaccaggtcactgct

SEQ ID NO: 170 - DNA, 25 bp, Homo sapiens
gcagttttctgcctccaggaaatac

SEQ ID NO: 171 - DNA, 18 bp, Homo sapiens
aactgacgaccaagacca

SEQ ID NO: 172 - DNA, 17 bp, Homo sapiens
actgacgaccaagaccg

SEQ ID NO: 173 - DNA, 23 bp, Homo sapiens
tgagtggtgcctgccttactatt

SEQ ID NO: 174 - DNA, 18 bp, Homo sapiens
cgaagttctctggtcccg

SEQ ID NO: 175 - DNA, 18 bp, Homo sapiens
cgaagttctctggtccca

SEQ ID NO: 176 - DNA, 22 bp, Homo sapiens
ccgcacccactgtctgataaac

SEQ ID NO: 177 - DNA, 22 bp, Homo sapiens
ctacatcaccctctttgcaata

SEQ ID NO: 178 - DNA, 20 bp, Homo sapiens
acatcaccctctttgcaatg

SEQ ID NO: 179 - DNA, 26 bp, Homo sapiens
cggtggttcttcacaggtttctaata

SEQ ID NO: 180 - DNA, 23 bp, Homo sapiens
agcttttgcaagctcaaaattac

SEQ ID NO: 181 - DNA, 23 bp, Homo sapiens
agcttttgcaagctcaaaattaa

SEQ ID NO: 182 - DNA, 22 bp, Homo sapiens
caggccaccactgtgaaagtaa

SEQ ID NO: 183 - DNA, 22 bp, Homo sapiens
acactgtggtaaatgctgtatt

SEQ ID NO: 184 - DNA, 23 bp, Homo sapiens
gacactgtggtaaatgctgtata

SEQ ID NO: 185 - DNA, 23 bp, Homo sapiens
cccagccatatggaactgtaagt

SEQ ID NO: 186 - DNA, 23 bp, Homo sapiens
gggaagcaaaattaacctttact

SEQ ID NO: 187 - DNA, 23 bp, Homo sapiens
gggaagcaaaattaacctttacc

SEQ ID NO: 188 - DNA, 25 bp, Homo sapiens
cacatttgccagagatgcacttcta

SEQ ID NO: 189 - DNA, 22 bp, Homo sapiens
gatgggttaaaatgggcaattc

SEQ ID NO: 190 - DNA, 23 bp, Homo sapiens
tgatgggttaaaatgggcaatta

SEQ ID NO: 191 - DNA, 25 bp, Homo sapiens
gctaacagttgcttccatctctaca

SEQ ID NO: 192 - DNA, 19 bp, Homo sapiens
caatgagcatttagcatcg

SEQ ID NO: 193 - DNA, 21 bp, Homo sapiens
ttcaatgagcatttagcatct

SEQ ID NO: 194 - DNA, 23 bp, Homo sapiens
tggaggaaaagtggaagatatta

SEQ ID NO: 195 - DNA, 21 bp, Homo sapiens
gcaccaaagaaagggataaac

SEQ ID NO: 196 - DNA, 21 bp, Homo sapiens
gcaccaaagaaagggataaaa

SEQ ID NO: 197 - DNA, 21 bp, Homo sapiens
cctcatcgagttttggagtct

SEQ ID NO: 198 - DNA, 20 bp, Homo sapiens
catctgtctgcttctcacag

SEQ ID NO: 199 - DNA, 20 bp, Homo sapiens
catctgtctgcttctcacat

SEQ ID NO: 200 - DNA, 20 bp, Homo sapiens
gtctggaaggcaaaaagatc

What is claimed is:

1. A method of administering an anti-IL-12p40 antibody to a human, the method comprising:

testing nucleic acid from said human to determine the nucleotide content of a polymorphism in gene IL23R at position 101 of SEQ ID NO:38 or the complement of SEQ ID NO:38, wherein the presence of G at position 101 of SEQ ID NO: 38 or C at position 101 of the complement of SEQ ID NO:38 is detected;

correlating the presence of said G or said C with said human having an increased risk for developing psoriasis; and administering said anti-IL-12p40 antibody to said human.

2. The method of claim 1, wherein said testing is performed using sequencing, 5' nuclease digestion, molecular beacon assay, oligonucleotide ligation assay, size analysis, and single-stranded conformation polymorphism analysis, or denaturing gradient gel electrophoresis (DGGE).

3. The method of claim 1, wherein said nucleic acid is a nucleic acid extract from a biological sample from said human.

4. The method of claim 3, wherein said biological sample is blood, saliva, or buccal cells.

5. The method of claim 3, further comprising preparing said nucleic acid extract from said biological sample prior to said testing.

6. The method of claim 5, further comprising obtaining said biological sample from said human prior to said preparing.

7. The method of claim 1, wherein said testing comprises nucleic acid amplification.

8. The method of claim 7, wherein said nucleic acid amplification is carried out by polymerase chain reaction.

9. The method of claim 1, wherein said testing is performed using an allele-specific method.

10. The method of claim 9, wherein said allele-specific method is allele-specific probe hybridization, allele-specific primer extension, or allele-specific amplification.

11. A method of determining that a human has an increased risk for developing psoriasis, the method comprising:

a) testing nucleic acid from said human to determine the nucleotide content of a polymorphism in gene IL23R at position 101 of SEQ ID NO:38 or the complement of SEQ ID NO:38; and b) correlating the presence of G at position 101 of SEQ ID NO:38 or C at position 101 of the complement of SEQ ID NO:38 with said human having said increased risk for developing psoriasis.

12. The method of claim 11, wherein said nucleic acid is a nucleic acid extract from a biological sample from said human.

13. The method of claim 12, wherein said biological sample is blood, saliva, or buccal cells.

14. The method of claim 12, further comprising preparing said nucleic acid extract from said biological sample prior to said testing.

15. The method of claim 14, further comprising obtaining said biological sample from said human prior to said preparing.

16. The method of claim 11, wherein said testing comprises nucleic acid amplification.

17. The method of claim 16, wherein said nucleic acid amplification is carried out by polymerase chain reaction.

18. The method of claim 11, wherein said testing is performed using sequencing, 5' nuclease digestion, molecular beacon assay, oligonucleotide ligation assay, size analysis, single-stranded conformation polymorphism analysis, or denaturing gradient gel electrophoresis (DGGE).

19. The method of claim 11, wherein said testing is performed using an allele-specific method.

20. The method of claim 19, wherein said allele-specific method is allele-specific probe hybridization, allele-specific primer extension, or allele-specific amplification.

21. The method of claim 1, wherein said human is homozygous for said G or said C.

22. The method of claim 1, wherein said human is heterozygous for said G or said C.

23. The method of claim 11, wherein said human is homozygous for said G or said C.

24. The method of claim 11, wherein said human is heterozygous for said G or said C.

* * * * *